US012502402B2

(12) United States Patent
Powers et al.

(10) Patent No.: US 12,502,402 B2
(45) Date of Patent: Dec. 23, 2025

(54) COMPOUNDS AND METHODS FOR MODULATING GFAP

(71) Applicant: Ionis Pharmaceuticals, Inc., Carlsbad, CA (US)

(72) Inventors: Berit Elissa Powers, Carlsbad, CA (US); Frank Rigo, Carlsbad, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 18/243,156

(22) Filed: Sep. 7, 2023

(65) Prior Publication Data

US 2024/0285669 A1 Aug. 29, 2024

Related U.S. Application Data

(63) Continuation of application No. 16/938,826, filed on Jul. 24, 2020, now Pat. No. 11,786,546.

(60) Provisional application No. 62/878,998, filed on Jul. 26, 2019.

(51) Int. Cl.

| | |
|---|---|
| ***A61K 31/712*** | (2006.01) |
| ***A61K 31/7125*** | (2006.01) |
| ***A61P 25/28*** | (2006.01) |
| ***C07H 21/02*** | (2006.01) |
| ***C12N 15/113*** | (2010.01) |

(52) U.S. Cl.

CPC ........ *A61K 31/712* (2013.01); *A61K 31/7125* (2013.01); *A61P 25/28* (2018.01); *C07H 21/02* (2013.01); *C12N 15/113* (2013.01); *C12N 2310/315* (2013.01); *C12N 2310/321* (2013.01); *C12N 2310/341* (2013.01)

(58) Field of Classification Search

CPC . C07H 21/02; C12N 15/113; C12N 2310/341
See application file for complete search history.

(56) References Cited

U.S. PATENT DOCUMENTS

| | | | |
|---|---|---|---|
| 3,687,808 | A | 8/1972 | Merigan et al. |
| 4,415,732 | A | 11/1983 | Caruthers et al. |
| 4,458,066 | A | 7/1984 | Caruthers et al. |
| 4,469,863 | A | 9/1984 | Ts'o et al. |
| 4,476,301 | A | 10/1984 | Imbach et al. |
| 4,500,707 | A | 2/1985 | Caruthers et al. |
| 4,668,777 | A | 5/1987 | Caruthers et al. |
| 4,725,677 | A | 2/1988 | Koster et al. |
| 4,845,205 | A | 7/1989 | Huynh Dinh et al. |
| 4,973,679 | A | 11/1990 | Caruthers et al. |
| 4,981,957 | A | 1/1991 | Lebleu et al. |
| 5,013,830 | A | 5/1991 | Ohutsuka et al. |
| 5,023,243 | A | 6/1991 | Tullis |
| 5,034,506 | A | 7/1991 | Summerton et al. |
| 5,118,800 | A | 6/1992 | Smith et al. |
| 5,130,302 | A | 7/1992 | Spielvogel et al. |
| 5,132,418 | A | 7/1992 | Caruthers et al. |
| 5,134,066 | A | 7/1992 | Rogers et al. |
| RE34,036 | E | 8/1992 | McGeehan |
| 5,149,797 | A | 9/1992 | Pederson et al. |
| 5,166,315 | A | 11/1992 | Summerton et al. |
| 5,175,273 | A | 12/1992 | Bischofberger et al. |
| 5,177,196 | A | 1/1993 | Meyer, Jr. et al. |
| 5,177,198 | A | 1/1993 | Spielvogel et al. |
| 5,185,444 | A | 2/1993 | Summerton et al. |
| 5,188,897 | A | 2/1993 | Suhadolnik et al. |
| 5,194,599 | A | 3/1993 | Froehler et al. |
| 5,214,134 | A | 5/1993 | Weis et al. |
| 5,216,141 | A | 6/1993 | Benner |
| 5,220,007 | A | 6/1993 | Pederson et al. |
| 5,223,618 | A | 6/1993 | Cook et al. |
| 5,235,033 | A | 8/1993 | Summerton et al. |
| 5,256,775 | A | 10/1993 | Froehler |
| 5,264,423 | A | 11/1993 | Cohen et al. |
| 5,264,562 | A | 11/1993 | Matteucci |
| 5,264,564 | A | 11/1993 | Matteucci |
| 5,276,019 | A | 1/1994 | Cohen et al. |
| 5,278,302 | A | 1/1994 | Caruthers et al. |
| 5,286,717 | A | 2/1994 | Cohen et al. |
| 5,319,080 | A | 6/1994 | Leumann |
| 5,321,131 | A | 6/1994 | Agrawal et al. |

(Continued)

FOREIGN PATENT DOCUMENTS

| | | |
|---|---|---|
| WO | WO 2006/006948 | 1/2006 |
| WO | WO 2013/022984 | 2/2013 |

(Continued)

OTHER PUBLICATIONS

Abdelhak et al., "Blood GFAP as an emerging biomarker in brain and spinal cord disorders" Nature Reviews Neurology (2022) 18: 158-172.

(Continued)

*Primary Examiner* — Eric Olson

(74) *Attorney, Agent, or Firm* — Arnold & Porter Kaye Scholer LLP

(57) ABSTRACT

Provided are compounds, methods, and pharmaceutical compositions for reducing the amount or activity of GFAP RNA in a cell or subject, and in certain instances reducing the amount of GFAP in a cell or subject. Such compounds, methods, and pharmaceutical compositions are useful to ameliorate at least one symptom or hallmark of a leukodystrophy. Such symptoms and hallmarks include motor delays, cognitive delays, paroxysmal deterioration, seizures, vomiting, swallowing difficulties, ataxic gait, palatal myoclonus, autonomic dysfunction, and presence of intra-astrocytic inclusions called Rosenthal fibers. Such leukodystrophies include Alexander Disease.

42 Claims, No Drawings

Specification includes a Sequence Listing.

(56) References Cited

U.S. PATENT DOCUMENTS

| | | | |
|---|---|---|---|
| 5,359,044 | A | 10/1994 | Cook et al. |
| 5,366,878 | A | 11/1994 | Pederson et al. |
| 5,367,066 | A | 11/1994 | Urdea et al. |
| 5,378,825 | A | 1/1995 | Cook et al. |
| 5,386,023 | A | 1/1995 | Sanghvi et al. |
| 5,393,878 | A | 2/1995 | Leumann |
| 5,399,676 | A | 3/1995 | Froehler |
| 5,403,711 | A | 4/1995 | Walder et al. |
| 5,405,938 | A | 4/1995 | Sumerton et al. |
| 5,405,939 | A | 4/1995 | Suhadolnik et al. |
| 5,432,272 | A | 7/1995 | Benner |
| 5,434,257 | A | 7/1995 | Matteucci |
| 5,446,137 | A | 8/1995 | Maag et al. |
| 5,453,496 | A | 9/1995 | Caruthers et al. |
| 5,455,233 | A | 10/1995 | Spielvogel et al. |
| 5,457,187 | A | 10/1995 | Gmelner et al. |
| 5,457,191 | A | 10/1995 | Cook et al. |
| 5,459,255 | A | 10/1995 | Cook et al. |
| 5,466,677 | A | 11/1995 | Baxter et al. |
| 5,466,786 | A | 11/1995 | Burh et al. |
| 5,470,967 | A | 11/1995 | Huie et al. |
| 5,476,925 | A | 12/1995 | Letsinger et al. |
| 5,484,908 | A | 1/1996 | Froehler et al. |
| 5,489,677 | A | 2/1996 | Sanghvi et al. |
| 5,491,133 | A | 2/1996 | Walder et al. |
| 5,502,177 | A | 3/1996 | Matteucci et al. |
| 5,508,270 | A | 4/1996 | Baxter et al. |
| 5,514,785 | A | 5/1996 | Van Ness et al. |
| 5,519,126 | A | 5/1996 | Hecht |
| 5,519,134 | A | 5/1996 | Acevedo et al. |
| 5,525,711 | A | 6/1996 | Hawkins et al. |
| 5,527,899 | A | 6/1996 | Froehler |
| 5,536,821 | A | 7/1996 | Agrawal et al. |
| 5,541,306 | A | 7/1996 | Agrawal et al. |
| 5,541,307 | A | 7/1996 | Cook et al. |
| 5,550,111 | A | 8/1996 | Suhadolnik et al. |
| 5,552,540 | A | 9/1996 | Haralambidis |
| 5,561,225 | A | 10/1996 | Maddry et al. |
| 5,563,253 | A | 10/1996 | Agrawal et al. |
| 5,565,350 | A | 10/1996 | Kmiec |
| 5,565,555 | A | 10/1996 | Froehler et al. |
| 5,567,811 | A | 10/1996 | Mistura et al. |
| 5,571,799 | A | 11/1996 | Tkachuk et al. |
| 5,576,427 | A | 11/1996 | Cook et al. |
| 5,587,361 | A | 12/1996 | Cook et al. |
| 5,587,469 | A | 12/1996 | Cook et al. |
| 5,587,470 | A | 12/1996 | Cook et al. |
| 5,591,722 | A | 1/1997 | Montgomery et al. |
| 5,594,121 | A | 1/1997 | Froehler et al. |
| 5,596,086 | A | 1/1997 | Matteucci |
| 5,596,091 | A | 1/1997 | Switzer |
| 5,597,909 | A | 1/1997 | Urdea et al. |
| 5,602,240 | A | 2/1997 | De Mesmaeker et al. |
| 5,608,046 | A | 3/1997 | Cook et al. |
| 5,610,289 | A | 3/1997 | Cook et al. |
| 5,610,300 | A | 3/1997 | Altmann et al. |
| 5,614,617 | A | 3/1997 | Cook et al. |
| 5,618,704 | A | 4/1997 | Sanghvi et al. |
| 5,623,065 | A | 4/1997 | Cook et al. |
| 5,623,070 | A | 4/1997 | Cook et al. |
| 5,625,050 | A | 4/1997 | Beaton et al. |
| 5,627,053 | A | 5/1997 | Usman et al. |
| 5,633,360 | A | 5/1997 | Bishofberger et al. |
| 5,639,873 | A | 6/1997 | Barascut et al. |
| 5,645,985 | A | 7/1997 | Froehler et al. |
| 5,646,265 | A | 7/1997 | McGee |
| 5,646,269 | A | 7/1997 | Matteucci |
| 5,652,355 | A | 7/1997 | Metelev et al. |
| 5,652,356 | A | 7/1997 | Agrawal |
| 5,663,312 | A | 9/1997 | Chaturvedula |
| 5,670,633 | A | 9/1997 | Cook et al. |
| 5,672,697 | A | 9/1997 | Buhr et al. |
| 5,677,437 | A | 10/1997 | Teng et al. |
| 5,677,439 | A | 10/1997 | Weis et al. |
| 5,681,941 | A | 10/1997 | Cook et al. |
| 5,698,685 | A | 12/1997 | Summerton et al. |
| 5,700,920 | A | 12/1997 | Altmann et al. |
| 5,700,922 | A | 12/1997 | Cook |
| 5,721,218 | A | 2/1998 | Froehler |
| 5,750,692 | A | 5/1998 | Cook et al. |
| 5,763,588 | A | 6/1998 | Matteucci et al. |
| 5,792,608 | A | 8/1998 | Swaminathan et al. |
| 5,792,847 | A | 8/1998 | Burh et al. |
| 5,801,154 | A | 9/1998 | Baracchini et al. |
| 5,808,027 | A | 9/1998 | Cook et al. |
| 5,830,653 | A | 11/1998 | Froehler et al. |
| 5,859,221 | A | 1/1999 | Cook et al. |
| 5,948,903 | A | 9/1999 | Cook et al. |
| 5,994,517 | A | 11/1999 | Ts'O |
| 6,005,087 | A | 12/1999 | Cook et al. |
| 6,005,096 | A | 12/1999 | Matteucci et al. |
| 6,166,199 | A | 12/2000 | Cook et al. |
| 6,268,490 | B1 | 7/2001 | Imanishi et al. |
| 6,300,319 | B1 | 10/2001 | Manoharan |
| 6,426,220 | B1 | 7/2002 | Bennett et al. |
| 6,525,191 | B1 | 2/2003 | Ramasamy |
| 6,531,584 | B1 | 3/2003 | Cook et al. |
| 6,582,908 | B2 | 6/2003 | Fodor et al. |
| 6,600,032 | B1 | 7/2003 | Manoharan et al. |
| 6,660,720 | B2 | 12/2003 | Manoharan |
| 6,670,461 | B1 | 12/2003 | Wengel et al. |
| 6,770,748 | B2 | 8/2004 | Imanishi et al. |
| 6,794,499 | B2 | 9/2004 | Wengel et al. |
| 6,906,182 | B2 | 6/2005 | Ts'o et al. |
| 7,015,315 | B1 | 3/2006 | Cook et al. |
| 7,034,133 | B2 | 4/2006 | Wengel et al. |
| 7,053,207 | B2 | 5/2006 | Wengel et al. |
| 7,101,993 | B1 | 9/2006 | Cook et al. |
| 7,262,177 | B2 | 8/2007 | Ts'o et al. |
| 7,399,845 | B2 | 7/2008 | Seth et al. |
| 7,427,672 | B2 | 9/2008 | Imanishi et al. |
| 7,491,805 | B2 | 2/2009 | Vargeese et al. |
| 7,547,684 | B2 | 6/2009 | Seth et al. |
| 7,569,686 | B1 | 8/2009 | Bhat et al. |
| 7,572,582 | B2 | 8/2009 | Wengel et al. |
| 7,666,854 | B2 | 2/2010 | Seth et al. |
| 7,696,345 | B2 | 4/2010 | Allerson et al. |
| 7,723,509 | B2 | 5/2010 | Manoharan et al. |
| 7,741,457 | B2 | 6/2010 | Swayze et al. |
| 7,750,131 | B2 | 7/2010 | Seth et al. |
| 7,875,733 | B2 | 1/2011 | Bhat et al. |
| 7,888,497 | B2 | 2/2011 | Bentwich et al. |
| 7,939,677 | B2 | 5/2011 | Bhat et al. |
| 8,022,193 | B2 | 9/2011 | Swayze et al. |
| 8,030,467 | B2 | 10/2011 | Seth et al. |
| 8,034,909 | B2 | 10/2011 | Wengel et al. |
| 8,080,644 | B2 | 12/2011 | Wengel et al. |
| 8,088,746 | B2 | 1/2012 | Seth et al. |
| 8,088,904 | B2 | 1/2012 | Swayze et al. |
| 8,090,542 | B2 | 1/2012 | Khvorova et al. |
| 8,106,022 | B2 | 1/2012 | Manoharan et al. |
| 8,124,745 | B2 | 2/2012 | Allerson et al. |
| 8,153,365 | B2 | 4/2012 | Wengel et al. |
| 8,268,980 | B2 | 9/2012 | Seth et al. |
| 8,278,283 | B2 | 10/2012 | Seth et al. |
| 8,278,425 | B2 | 10/2012 | Prakash et al. |
| 8,278,426 | B2 | 10/2012 | Seth et al. |
| 8,372,808 | B2 | 2/2013 | Messing et al. |
| 8,440,803 | B2 | 5/2013 | Swayze et al. |
| 8,501,805 | B2 | 8/2013 | Seth et al. |
| 8,530,640 | B2 | 9/2013 | Seth et al. |
| 8,546,556 | B2 | 10/2013 | Seth et al. |
| RE44,779 | E | 2/2014 | Imanishi et al. |
| 8,828,956 | B2 | 9/2014 | Manoharan et al. |
| 9,005,906 | B2 | 4/2015 | Swayze et al. |
| 9,012,421 | B2 | 4/2015 | Migawa et al. |
| 9,127,276 | B2 | 9/2015 | Prakash et al. |
| 9,290,760 | B2 | 3/2016 | Rajeev et al. |
| 9,550,988 | B2 | 1/2017 | Swayze |
| 11,786,546 | B2 | 10/2023 | Powers et al. |
| 2001/0053519 | A1 | 12/2001 | Fodor et al. |
| 2003/0082807 | A1 | 5/2003 | Wengel |
| 2003/0158403 | A1 | 8/2003 | Manoharan et al. |
| 2003/0175906 | A1 | 9/2003 | Manoharan et al. |

(56) References Cited

U.S. PATENT DOCUMENTS

2003/0207841 A1 11/2003 Kaneko et al.
2003/0224377 A1 12/2003 Wengel et al.
2003/0228597 A1 12/2003 Cowsert et al.
2004/0143114 A1 7/2004 Imanishi et al.
2004/0171570 A1 9/2004 Allerson et al.
2004/0192918 A1 9/2004 Imanishi et al.
2005/0130923 A1 6/2005 Bhat et al.
2005/0255487 A1 11/2005 Khvorova et al.
2006/0148740 A1 7/2006 Platenburg
2007/0031844 A1 2/2007 Khvorova et al.
2008/0039618 A1 2/2008 Allerson et al.
2008/0113351 A1 5/2008 Naito et al.
2010/0190837 A1 7/2010 Migawa et al.
2010/0197762 A1 8/2010 Swayze et al.
2011/0123520 A1 5/2011 Manoharan et al.
2013/0130378 A1 5/2013 Manoharan et al.
2013/0203836 A1 8/2013 Rajeev et al.
2013/0237585 A1 9/2013 Bennett et al.
2014/0107330 A1 4/2014 Freier et al.
2015/0018540 A1 1/2015 Prakash et al.
2015/0184153 A1 7/2015 Freier et al.
2015/0191727 A1 7/2015 Migawa et al.
2015/0267195 A1 9/2015 Seth et al.
2015/0275212 A1 10/2015 Albaek et al.
2021/0038629 A1 2/2021 Powers et al.

FOREIGN PATENT DOCUMENTS

WO WO 2013/173635 11/2013
WO WO 2019/089692 5/2019
WO WO 2021/021673 2/2021

OTHER PUBLICATIONS

Austin et al., "The neuro-immune balance in neuropathic pain: Involvement of inflammatory immune cells, immune-like glial cells and cytokines" J Neurol (2010) 229: 26-50.
Branch et al., "A good antisense molecule is hard to find," TIBS (1998) 23:45-50.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Crooke et al., "Basic Principles of Antisense Therapeutics" Antisense Research and Application (1998) Chapter 1:1-50.
Crooke, ST., et al., "Antisense Drug Technology" Second Edition, CRC Press (2008) Chapters 1-28.
Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.
European Search Report for 20846055.0 dated Oct. 13, 2022.
Gautschi et al., "Activity of a novel bel-2/bcl-xLbispecific antisense oligonucleotide against tumors of diverse histologic origins" J. Natl. Cancer Inst. (2001) 93:463-471.
Hagemann et al., "Antisense suppression of glial fibrillary acidic protein as a treatment for Alexander disease" Ann Neurol (2018) 83: 27-39.
International Search Report for PCT/US20/043602 dated Dec. 15, 2020.
Kanski et al., "Histone Acetylation in Astrocytes Suppresses GFAP and Stimulates a Reorganization of the Intermediate Filament Network" J. Cell Sci (2014) 127: 4368-4380.
Kim et al., "Profiling of dynamically changed gene expression in dorsal root ganglia post peripheral nerve injury and a critical role of injury-induced glial fibrillary acetic protein in maintenance of pain behaviors" Pain (2009) 143: 114-122.
Kimura et al., "Clinical characteristics of autoimmune GFAP astrocytopathy" J Neurology (2019) 332: 91-98.
Maher et al., "Comparative hybrid arrest by tandem antisense oligodeoxyribonucleotides or oligodeoxyribonucleoside methylpbosphonates in a cell-free system" Nucl. Acid. Res. (1988) 16(8):3341-3358.
Messing et al., "Strategies for treatment in Alexander disease" Neurotherapeutics (2010) 7: 507-515.
Messing et al., "Fatal encephalopathy with astrocyte inclusions in GFAP transgenic mice" Am J Pathol (1998) 152: 391-398.
Messing et al., "GFAP at 50" ASN Neurology (2020) 1-23.
Middeldorp et al., "GFAP in health and disease" Progress in Neurology (2011) 93: 421-443.
New England Biolabs 1998/99 Catalog (cover page and pp. 121 and 284).
Powers et al., "Antisense Oligonucleotides (ASOs) Targeting Mouse Gfap Reverse Pathology in a Model of Alexander Disease" Poster for SfN 46th Annual Meeting—Neuroscience 2016: San Diego, CA (Nov. 12-16, 2016).
Powers et al., "Antisense Oligonucleotide Therapy Elicits Rapid, Sustained Pathology Reversal in a Mouse Model of Alexander Disease" Poster for SfN 47th Annual Meeting—Neuroscience 2017: Washington D.C. (Nov. 11-15, 2017).
Prust et al., "GFAP mutations, age at onset, and clinical subtypes in Alexander disease" Neurology (2011) 77: 1287-1294.
Quinlan et al., "GFAP and its role in Alexander disease" Experimental Cell Res (2007) 313: 2077-2087.
Reynolds et al., "Rational siRNA design for RNA interference" Nature Biotechnology (2004) 22(3):326-330.
Rothstein et al., "Knockout of Glutamate Transporters Reveals a Major Role for Astroglial Transport in Excitotoxicity and Clearance of Glutamate" Neuron (1996) 16: 675-686.
Sanghvi et al., "Heterocyclic Base Modifications in Nucleic Acids and Their Applications in Antisense Oligonucleotides" Antisense Research and Applications (1993) pp. 273-288.
Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.
Smith et al., "Therapeutic Oligonucleotides: State of the Art" Ann Rev Pharmacol Toxicol (2019) 59: 605-630.
Woolf et al., "Specificity of antisense oligonucleotides in vivo" PNAS (1992) 89: 7305-7309.
Yu et al., Astrogliosis in Culture: I. The Model and the Effect of Antisense Oligonucleotides on Glial Fibrillary Acidic Protein Synthesis J. Nuerosci. Res (1993) 34: 295-303.
Yu et al. (1993) Biology and Pathology of Astrocyte-Neuron Interactions. New York, NY: Penum Press. pp. 313-325.

COMPOUNDS AND METHODS FOR MODULATING GFAP

SEQUENCE LISTING

This application incorporates by reference a 2,616,122 byte xml file named "BIOL0353SEQ.xml," created on Sep. 5, 2023, which is the sequence listing for this application.

FIELD

Provided are compounds, methods, and pharmaceutical compositions for reducing the amount or activity of GFAP RNA in a cell or subject, and in certain instances reducing the amount of glial fibrillary acidic protein (GFAP) in a cell or subject. Such compounds, methods, and pharmaceutical compositions are useful to ameliorate at least one symptom or hallmark of a leukodystrophy. Such symptoms and hallmarks include motor delays, cognitive delays, paroxysmal deterioration, seizures, vomiting, swallowing difficulties, ataxic gait, palatal myoclonus, autonomic dysfunction, and intra-astrocytic inclusions called Rosenthal fibers. Such leukodystrophies include Alexander Disease.

BACKGROUND

Alexander Disease (AxD) is a rare developmental disorder that affects ~1/1,000,000 live births and is caused by a number of different autosomal dominant mutations in the gene encoding glial fibrillary acidic protein, GFAP. AxD is a typically fatal leukodystrophy with early onset (<age 4, Type I) or later onset (>age 4 Type II) forms (Prust et al., (2011) GFAP mutations, age at onset, and clinical subtypes in Alexander disease. Neurol 77; 1287-1294). Symptoms include motor and cognitive delays, paroxysmal deterioration, seizures, encephalopathy, macrocephaly, and intra-astrocytic inclusions called Rosenthal fibers.

There are no specific therapies for AxD, with current treatments being limited to supportive treatments for individual symptoms (e.g., antiepileptics to prevent seizures; Messing, et. al., "Strategies for treatment in Alexander Disease", *Neurotherapeutics: The Journal of the Am. Soc. For Expt. NeuroTher.,* 2016).

Currently there is a lack of acceptable options for treating leukody strophies such as AxD. It is therefore an object herein to provide compounds, methods, and pharmaceutical compositions for the treatment of such diseases.

SUMMARY OF THE INVENTION

Provided herein are compounds, methods and pharmaceutical compositions for reducing the amount or activity of GFAP RNA, and in certain embodiments reducing the expression of glial fibrillary acidic protein in a cell or subject. In certain embodiments, the subject has a leukodystrophy. In certain embodiments, the subject has Alexander Disease (AxD). In certain embodiments, compounds useful for reducing the amount or activity of GFAP RNA are oligomeric compounds. In certain embodiments, compounds useful for reducing the amount or activity of GFAP RNA are modified oligonucleotides. In certain embodiments, compounds useful for decreasing expression of glial fibrillary acidic protein are oligomeric compounds. In certain embodiments, compounds useful for decreasing expression of glial fibrillary acidic protein are modified oligonucleotides.

Also provided are methods useful for ameliorating at least one symptom or hallmark of a leukodystrophy. In certain embodiments, the leukodystrophy is Alexander Disease. In certain embodiments, the symptom or hallmark includes motor delays, cognitive delays, paroxysmal deterioration, seizures, vomiting, swallowing difficulties, ataxic gait, palatal myoclonus, autonomic dysfunction, and presence of intra-astrocytic inclusions called Rosenthal fibers.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, treatises, and GenBank, ENSEMBL, and NCBI reference sequence records, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyfuranosylsugar moiety. In certain embodiments, a 2'-deoxy nucleoside is a 2'-β-Ddeoxynucleoside and comprises a 2'-β-D-deoxyribosyl sugar moiety, which has the β-D ribosyl configuration as found in naturally occurring deoxyribonucleic acids (DNA). In certain embodiments, a 2'-deoxynucleoside may comprise a modified nucleobase or may comprise an RNA nucleobase (uracil).

As used herein, "2'-MOE" or "2'-MOE sugar moiety" means a 2'-$OCH_2CH_2OCH_3$ group in place of the 2'-OH group of a furanosyl sugar moiety. A "2'-MOE sugar moiety" means a sugar moiety with a 2'-$OCH_2CH_2OCH_3$ group in place of the 2'-OH group of a furanosyl sugar moiety. Unless otherwise indicated, a 2'-MOE sugar moiety is in the β-D-ribosyl configuration. "MOE" means O-methoxyethyl.

As used herein, "2'-MOE nucleoside" means a nucleoside comprising a 2'-MOE sugar moiety.

As used herein, “2'-OMe” or “2'-O-methyl sugar moiety” means a 2'-$OCH_3$ group in place of the 2'-OH group of a furanosyl sugar moiety. A “2'-O-methyl sugar moiety” or “2'-OMe sugar moiety” means a sugar moiety with a 2'-$OCH_3$ group in place of the 2'-OH group of a furanosyl sugar moiety. Unless otherwise indicated, a 2'-OMe sugar moiety is in the β-D-ribosyl configuration.

As used herein, “2'-OMe nucleoside” means a nucleoside comprising a 2'-OMe sugar moiety.

As used herein, “2'-substituted nucleoside” means a nucleoside comprising a 2'-substituted sugar moiety. As used herein, “2'-substituted” in reference to a sugar moiety means a sugar moiety comprising at least one 2'-substituent group other than H or OH.

As used herein, “5-methylcytosine” means a cytosine modified with a methyl group attached to the 5 position. A 5-methylcytosine is a modified nucleobase.

As used herein, “administering” means providing a pharmaceutical agent to a subject.

As used herein, “antisense activity” means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, “antisense compound” means an oligomeric compound capable of achieving at least one antisense activity.

As used herein, “ameliorate” in reference to a treatment means improvement in at least one symptom or hallmark relative to the same symptom or hallmark in the absence of the treatment. In certain embodiments, amelioration is the reduction in the severity or frequency of a symptom or the delayed onset or slowing of progression in the severity or frequency of a symptom. In certain embodiments, the symptom or hallmark is motor delays, cognitive delays, paroxysmal deterioration, seizures, vomiting, swallowing difficulties, ataxic gait, palatal myoclonus, autonomic dysfunction, and presence of intra-astrocytic inclusions called Rosenthal fibers.

As used herein, “bicyclic nucleoside” or “BNA” means a nucleoside comprising a bicyclic sugar moiety.

As used herein, “bicyclic sugar” or “bicyclic sugar moiety” means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the furanosyl sugar moiety is a ribosyl moiety. In certain embodiments, the bicyclic sugar moiety does not comprise a furanosyl moiety.

As used herein, “cerebrospinal fluid” or “CSF” means the fluid filling the space around the brain and spinal cord. “Artificial cerebrospinal fluid” or “aCSF” means a prepared or manufactured fluid that has certain properties of cerebrospinal fluid.

As used herein, “cleavable moiety” means a bond or group of atoms that is cleaved under physiological conditions, for example, inside a cell, an animal, or a human.

As used herein, “complementary” in reference to an oligonucleotide means that at least 70% of the nucleobases of the oligonucleotide or one or more portions thereof and the nucleobases of another nucleic acid or one or more portions thereof are capable of hydrogen bonding with one another when the nucleobase sequence of the oligonucleotide and the other nucleic acid are aligned in opposing directions. As used herein, “complementary nucleobases” means nucleobases that are capable of forming hydrogen bonds with one another. Complementary nucleobase pairs include adenine (A) and thymine (T), adenine (A) and uracil (U), cytosine (C) and guanine (G), 5-methylcytosine ($^{m}$C) and guanine (G). Complementary oligonucleotides and/or target nucleic acids need not have nucleobase complementarity at each nucleoside. Rather, some mismatches are tolerated. As used herein, “fully complementary” or “100% complementary” in reference to an oligonucleotide, or a portion thereof, means that the oligonucleotide, or portion thereof, is complementary to another oligonucleotide or target nucleic acid at each nucleobase of the shorter of the two oligonucleotides, or at each nucleoside if the oligonucleotides are the same length.

As used herein, “conjugate group” means a group of atoms that is directly or indirectly attached to an oligonucleotide. Conjugate groups include a conjugate moiety and a conjugate linker that attaches the conjugate moiety to the oligonucleotide.

As used herein, “conjugate linker” means a single bond or a group of atoms comprising at least one bond that connects a conjugate moiety to an oligonucleotide.

As used herein, “conjugate moiety” means a group of atoms that is attached to an oligonucleotide via a conjugate linker.

As used herein, “contiguous” in the context of an oligonucleotide refers to nucleosides, nucleobases, sugar moieties, or internucleoside linkages that are immediately adjacent to each other. For example. “contiguous nucleobases” means nucleobases that are immediately adjacent to each other in a sequence.

As used herein, “constrained ethyl” or “cEt” or “cEt modified sugar moiety” means a 4' to 2' bridge in place of the 2'OH-group of a ribosyl sugar moiety, wherein the bridge has the formula of 4'-CH(CH)—O-2', and wherein the methyl group of the bridge is in the S configuration. A “cEt sugar moiety” is a bicyclic sugar moiety with a 4' to 2' bridge in place of the 2'OH-group of a ribosyl sugar moiety, wherein the bridge has the formula 4'-$CH(CH_3)$—O-2', and wherein the methyl group of the bridge is in the S configuration.

As used herein, “cEt nucleoside” means a nucleoside comprising a cEt sugar moiety.

As used herein, “chirally enriched population” means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, “chirally controlled” in reference to an internucleoside linkage means chirality at that linkage is enriched for a particular stereochemical configuration.

As used herein, “deoxy region” means a region of 5-12 contiguous nucleotides, wherein at least 70% of the nucleosides are 2'-β-D-deoxynucleosides. In certain embodiments, each nucleoside is selected from a 2'-β-D-deoxynucleoside, a bicyclic nucleoside, and a 2'-substituted nucleoside. In certain embodiments, a deoxy region supports RNase H activity. In certain embodiments, a deoxy region is the gap or internal region of a gapmer.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." The internal region is a deoxy region. The positions of the internal region or gap refer to the order of the nucleosides of the internal region and are counted starting from the 5'-end of the internal region. Unless otherwise indicated. "gapmer" refers to a sugar motif. Unless otherwise indicated, the sugar moiety of each nucleoside of the gap is a 2'-β-D-deoxynucleoside. In certain embodiments, the gap comprises one 2'-substituted nucleoside at position 1, 2, 3, 4, or 5 of the gap, and the remainder of the nucleosides of the gap ar 2'-β-D-deoxynucleosides. As used herein, the term "MOE gapmer" indicates a gapmer having a gap comprising 2'-β-D-deoxynucleosides and wings comprising 2'-MOE nucleosides. As used herein, the term "mixed wing gapmer" indicates a gapmer having wings comprising modified nucleosides comprising at least two different sugar modifications. Unless otherwise indicated, a gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid that is amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, "internucleoside linkage" means the covalent linkage between contiguous nucleosides in an oligonucleotide. As used herein, "modified internucleoside linkage" means any internucleoside linkage other than a phosphodiester internucleoside linkage. "Phosphorothioate internucleoside linkage or "PS internucleoside linkage" is a modified internucleoside linkage in which one of the non-bridging oxygen atoms of a phosphodiester internucleoside linkage is replaced with a sulfur atom.

As used herein, "leukodystrophy" means a disorder due to abnormalities in the myelin sheath of neurons.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "motif" means the pattern of unmodified and/or modified sugar moieties, nucleobases, and/or internucleoside linkages, in an oligonucleotide.

As used herein, "nucleobase" means an unmodified nucleobase or a modified nucleobase. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase. A "5-methylcytosine" is a modified nucleobase. A universal base is a modified nucleobase that can pair with any one of the five unmodified nucleobases. As used herein, "nucleobase sequence" means the order of contiguous nucleobases in a target nucleic acid or oligonucleotide independent of any sugar or internucleoside linkage modification.

As used herein, "nucleoside" means a compound, or a fragment of a compound, comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to a subject. Certain such carriers enable pharmaceutical compositions to be formulated as, for example, tablets, pills, dragees, capsules, liquids, gels, syrups, slurries, suspension and lozenges for the oral ingestion by a subject.

In certain embodiments, a pharmaceutically acceptable carrier or diluent is sterile water, sterile saline, sterile buffer solution or sterile artificial cerebrospinal fluid.

As used herein, "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein, "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein, "prodrug" means a therapeutic agent in a form outside the body that is converted to a different form within a subject or cells thereof. Typically, conversion of a prodrug within the subject is facilitated by the action of an enzymes (e.g., endogenous or viral enzyme) or chemicals present in cells or tissues and/or by physiologic conditions.

As used herein, "reducing the amount or activity" refers to a reduction or blockade of the transcriptional expression or activity relative to the transcriptional expression or activity in an untreated or control sample and does not necessarily indicate a total elimination of transcriptional expression or activity.

As used herein, "RNA" means an RNA transcript and includes pre-mRNA and mature mRNA unless otherwise specified.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "standard in vitroassay" means the assay described in Example 1 and reasonable variations thereof.

As used herein, "standard in vivo assay" means the assay described in Example 7 and reasonable variations thereof.

As used herein, "stereomndom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein, "subject" means a human or non-human animal.

As used herein, "sugar moiety" means an unmodified sugar moiety or a modified sugar moiety. As used herein, "unmodified sugar moiety" means a 2'-OH(H) β-D-ribosyl moiety, as found in RNA (an "unmodified RNA sugar moiety"), or a 2'-H(H) β-D-deoxyribosyl sugar moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "symptom or hallmark" means any physical feature or test result that indicates the existence or extent of a disease or disorder. In certain embodiments, a symptom is apparent to a subject or to a medical professional examining or testing said subject. In certain embodiments, a hallmark is apparent upon invasive diagnostic testing, including, but not limited to, post-mortem tests. In certain embodiments, a hallmark is apparent on a brain MRI scan.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to a subject. For example, a therapeutically effective amount improves a symptom or hallmark of a disease.

CERTAIN EMBODIMENTS

The present disclosure provides the following non-limiting numbered embodiments:

Embodiment 1: An oligomeric compound comprising a modified oligonucleotide consisting of 12 to 30 linked nucleosides wherein the nucleobase sequence of the modified oligonucleotide is at least 90% complementary to an equal length portion of a GFAP nucleic acid, and wherein the modified oligonucleotide comprises at least one modification selected from a modified sugar moiety and a modified internucleoside linkage.

Embodiment 2: An oligomeric compound comprising a modified oligonucleotide consisting of 12 to 30 linked nucleosides and having a nucleobase sequence comprising at least 12, at least 13, at least 14, at least 15, at least 16, at least 17, at least 18, at least 19, or 20 contiguous nucleobases of any of SEQ ID NOs: 20-2809 or 2813, wherein the modified oligonucleotide comprises at least one modification selected from a modified sugar moiety and a modified internucleoside linkage.

Embodiment 3: An oligomeric compound comprising a modified oligonucleotide consisting of 12 to 30 linked nucleosides and having a nucleobase sequence comprising at least 12, at least 13, at least 14, at least 15, at least 16, at least 17, or 18 contiguous nucleobases of any of SEQ ID NOs: 2816-2837, 2839-2846, 2850-2854, 2856, 2859, 2861-2863, 2866, 2873-2876, 2886-2888, 2891, wherein the modified oligonucleotide comprises at least one modification selected from a modified sugar moiety and a modified internucleoside linkage.

Embodiment 4: An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 contiguous nucleobases complementary to:

an equal length portion of nucleobases 9324-9348 of SEQ ID NO: 2;

an equal length portion of nucleobases 9459-9480 of SEQ ID NO: 2;

an equal length portion of nucleobases 9530-9580 of SEQ ID NO: 2;

an equal length portion of nucleobases 12006-12038 of SEQ ID NO: 2; or an equal length portion of nucleobases 13038-13058 of SEQ ID NO: 2.

wherein the modified oligonucleotide comprises at least one modification selected from a modified sugar moiety and a modified internucleoside linkage.

Embodiment 5: An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, or at least 18 contiguous nucleobases of a sequence selected from:

SEQ ID Nos: 21, 1177, 2321, 2398, 2808-2809, 2840-2842, 2853-2854;

SEQ ID Nos: 555, 2093, 2170, 2813;

SEQ ID Nos: 20, 88, 166, 1331, 1408, 1485, 1637, 1713, 1714, 1789, 1790, 1637, 1638, 1865, 1866, 1941, 2018, 2095, 2172, 2249, 2326, 2403, 2480, 2557, 2633, 2709, 2785, 2816-2818, 2859, 2861, 2886-2887;

SEQ ID Nos: 815, 893, 971, 1049, 1269, 1270, 1346, 1423, 1499, 1500, 1660, 1736, 2655, 2731: or

SEQ ID Nos: 825, 1973.

Embodiment 6: The oligomeric compound of any of embodiments 1-5, wherein the modified oligonucleotide has a nucleobase sequence that is at least 80%, at least 85%, at least 90%, at least 95%, or 100% complementary to the nucleobase sequence of SEQ ID NO: 1, SEQ ID NO: 2 or SEQ ID NO: 3 when measured across the entire nucleobase sequence of the modified oligonucleotide.

Embodiment 7: The oligomeric compound of any of embodiments 1-6, wherein the modified oligonucleotide comprises at least one modified sugar moiety.

Embodiment 8: The oligomeric compound of embodiment 7, wherein the modified oligonucleotide comprises at least one bicyclic sugar moiety.

Embodiment 9: The oligomeric compound of embodiment 8, wherein the bicyclic sugar moiety has a 4'-2' bridge, wherein the 4'-2' bridge is selected from $CH_2$—O—; and —$CH(CH_3)$—O.

Embodiment 10: The oligomeric compound of any of embodiments 1-9, wherein the modified oligonucleotide comprises at least one non-bicyclic modified sugar moiety.

Embodiment 11: The oligomeric compound of embodiment 10, wherein the non-bicyclic modified sugar moiety is a 2'-MOE sugar moiety or a 2'-OMe sugar moiety.

Embodiment 12: The oligomeric compound of any of embodiments 1-11, wherein the modified oligonucleotide comprises at least one sugar surrogate.

Embodiment 13: The oligomeric compound of embodiment 12, wherein the sugar surrogate is any of morpholino, modified morpholino, PNA, THP, and F-HNA.

Embodiment 14: The oligomeric compound of any of embodiments 1-7 or 10-13, wherein the modified oligonucleotide does not comprise a bicyclic sugar moiety.

Embodiment 15: The oligomeric compound of any of embodiments 1-14, wherein the modified oligonucleotide is a gapmer.

Embodiment 16: The oligomeric compound of any of embodiments 1-15, wherein the modified oligonucleotide comprises:

a 5'-region consisting of 1-6 linked nucleosides;

a central region consisting of 6-10 linked nucleosides; and a 3'-region consisting of 1-6 linked nucleosides; wherein each of the 5'-region nucleosides and each of the 3'-region nucleosides comprises a modified sugar moiety and at least one of the central region nucleosides comprises a 2'-deoxyribosyl sugar moiety.

Embodiment 17: The oligomeric compound of embodiment 16, wherein the modified oligonucleotide comprises a 5'-region consisting of 6 linked nucleosides:

a central region consisting of 10 linked nucleosides; and a 3'-region consisting of 4 linked nucleosides: wherein each of the 5'-region nucleosides and each of the 3'-region nucleosides comprises a 2'-MOE modified sugar moiety, and each of the central region nucleosides comprises a 2'-deoxyribosyl sugar moiety.

Embodiment 18: The oligomeric compound of embodiment 16, wherein the modified oligonucleotide comprises:

a 5'-region consisting of 5 linked nucleosides;

a central region consisting of 10 linked nucleosides; and a 3'-region consisting of 5 linked nucleosides; wherein each of the 5'-region nucleosides and each of the 3'-region nucleosides comprises a 2'-MOE modified sugar moiety, and each of the central region nucleosides comprises a 2'-deoxyribosyl sugar moiety.

Embodiment 19: The oligomeric compound of embodiment 16, wherein the modified oligonucleotide comprises:

a 5'-region consisting of 4 linked nucleosides;

a central region consisting of 10 linked nucleosides; and a 3'-region consisting of 6 linked nucleosides; wherein each of the 5'-region nucleosides and each of the 3'-region nucleosides comprises a 2'-MOE modified sugar moiety, and each of the central region nucleosides comprises a 2'-deoxyribosyl sugar moiety.

Embodiment 20: The oligomeric compound of embodiment 16, wherein the modified oligonucleotide comprises a 5'-region consisting of 5 linked nucleosides;

a central region consisting of 8 linked nucleosides; and a 3'-region consisting of 5 linked nucleosides; wherein each of the 5'-region nucleosides and each of the 3'-region nucleosides comprises a 2'-MOE modified sugar moiety, and each of the central region nucleosides comprises a 2'-deoxyribosyl sugar moiety.

Embodiment 21: The oligomeric compound of any of embodiments 1-20, wherein the modified oligonucleotide comprises at least one modified internucleoside linkage.

Embodiment 22: The oligomeric compound of embodiment 21, wherein each internucleoside linkage of the modified oligonucleotide is a modified internucleoside linkage.

Embodiment 23: The oligomeric compound of embodiments 21 or 22, wherein the modified internucleoside linkage is a phosphorothioate internucleoside linkage.

Embodiment 24: The oligomeric compound of any one of embodiments 1-21, wherein the modified oligonucleotide comprises at least one phosphodiester internucleoside linkage.

Embodiment 25: The oligomeric compound of any of embodiments 21, 23, or 24, wherein each internucleoside linkage is either a phosphodiester internucleoside linkage or a phosphorothioate internucleoside linkage.

Embodiment 26: The oligomeric compound of any one of embodiments 1-21 or 23-25, wherein the modified oligonucleotide has an internucleoside linkage motif selected from among: sooosssssssssssooss, soooosssssssssssoss, soooossssssssssooss, sooosssssssssooss, or sooossssssssssoooss: wherein, s=a phosphothioate internucleoside linkage and o=a phosphodiester internucleoside linkage.

Embodiment 27: The oligomeric compound of any of embodiments 1-26, wherein the modified oligonucleotide comprises at least one modified nucleobase.

Embodiment 28: The oligomeric compound of embodiment 27, wherein the modified nucleobase is a 5-methylcytosine.

Embodiment 29: The oligomeric compound of any of embodiments 1-28, wherein the modified oligonucleotide consists of 12-30, 12-22, 12-20, 14-18, 14-20, 15-17, 15-25, 16-20, 18-22 or 18-20 linked nucleosides.

Embodiment 30: The oligomeric compound of any of embodiments 1-29, wherein the modified oligonucleotide consists of 18 linked nucleosides.

Embodiment 31: The oligomeric compound of any of embodiments 1-30, wherein the modified oligonucleotide consists of 20 linked nucleosides.

Embodiment 32: The oligomeric compound of any of embodiments 1-31, consisting of the modified oligonucleotide.

Embodiment 33: An oligomeric duplex comprising an oligomeric compound of any of embodiments 1-31.

Embodiment 34: An antisense compound comprising or consisting of an oligomeric compound of any of embodiments 1-32 or an oligomeric duplex of embodiment 33.

Embodiment 35: A pharmaceutical composition comprising an oligomeric compound of any of embodiments 1-32 or an oligomeric duplex of embodiment 33 and a pharmaceutically acceptable carrier or diluent.

Embodiment 36: The pharmaceutical composition of embodiment 35, wherein the pharmaceutically acceptable diluent is artificial cerebral spinal fluid.

Embodiment 37: The pharmaceutical composition of embodiment 36, wherein the pharmaceutical composition consists of the modified oligonucleotide and phosphate buffered saline.

Embodiment 38: A method comprising administering to a subject a pharmaceutical composition of any of embodiments 35-37.

Embodiment 39: A method of treating a disease associated with GFAP comprising administering to an individual having or at risk for developing a disease associated with GFAP a therapeutically effective amount of a compound of any one of embodiments 1-34 or a pharmaceutical composition according to any of embodiments 35-37; and thereby treating the disease associated with GFAP.

Embodiment 40: The method of embodiment 39, wherein the GFAP-associated disease is Alexander Disease.

Embodiment 41: The method of any of embodiments 38-40, wherein at least one symptom or hallmark of the GFAP-associated disease is ameliorated.

Embodiment 42: The method of embodiment 41, wherein the symptom or hallmark is motor delays, cognitive delays, paroxysmal deterioration, seizures, vomiting, swallowing difficulties, ataxic gait, palatal myoclonus, autonomic dysfunction, or the presence of intra-astrocytic inclusions called Rosenthal fibers.

Embodiment 43: The method of any of embodiments 38-42, wherein GFAP levels in the individual are reduced.

Embodiment 44: A modified oligonucleotide according to the following chemical structure:

(SEQ ID NO: 2905)

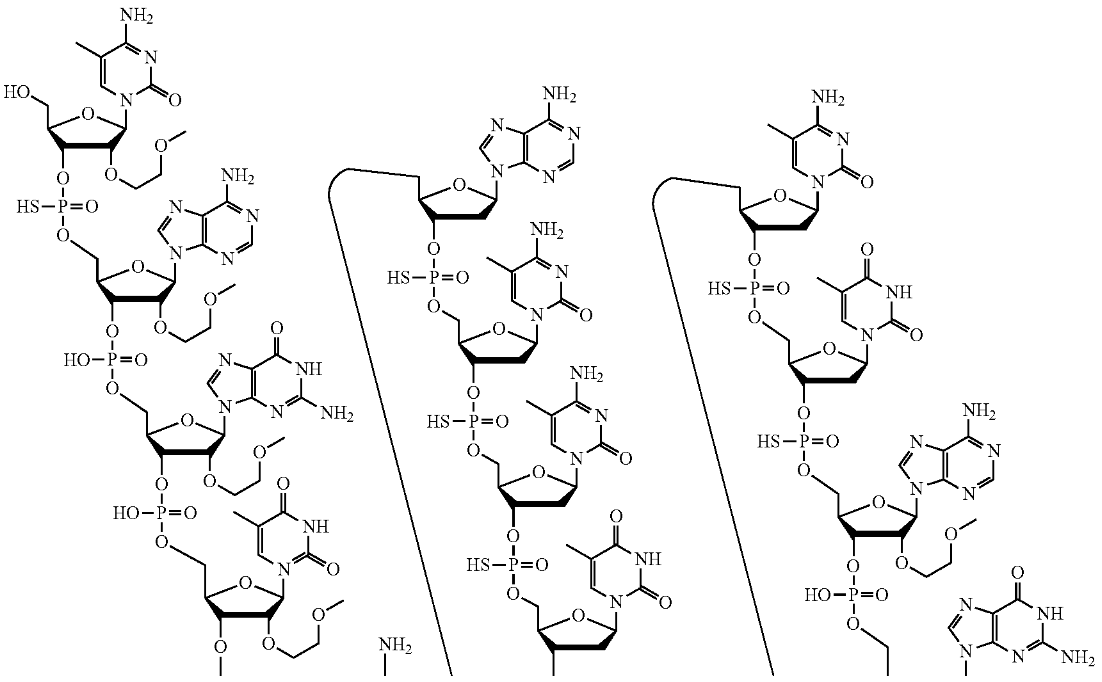

-continued
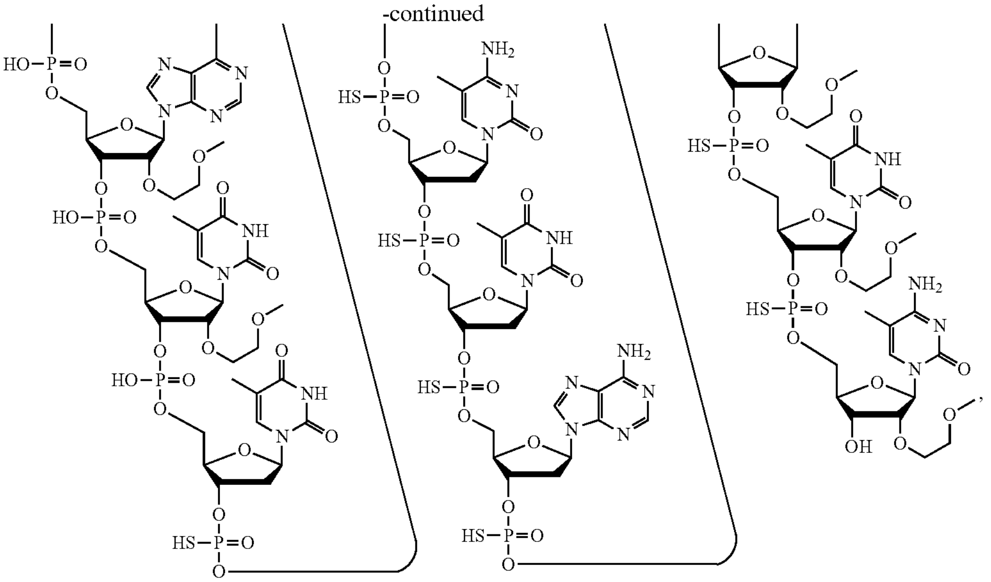
or a salt thereof.
Embodiment 45: A modified oligonucleotide according to the following chemical structure:
(SEQ ID NO: 2905)
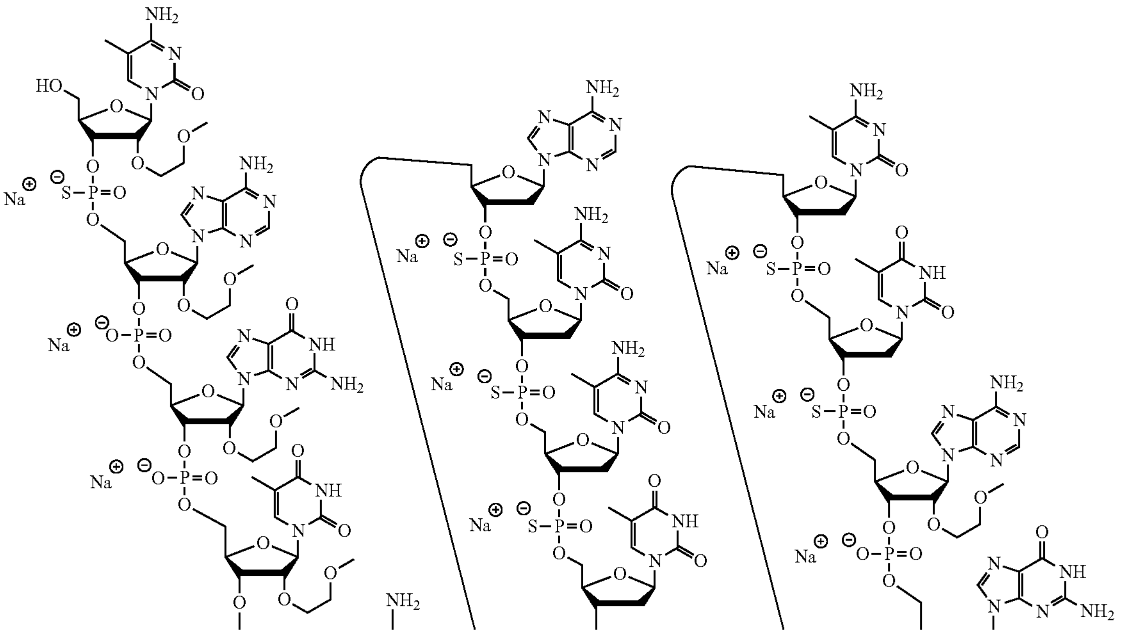

-continued
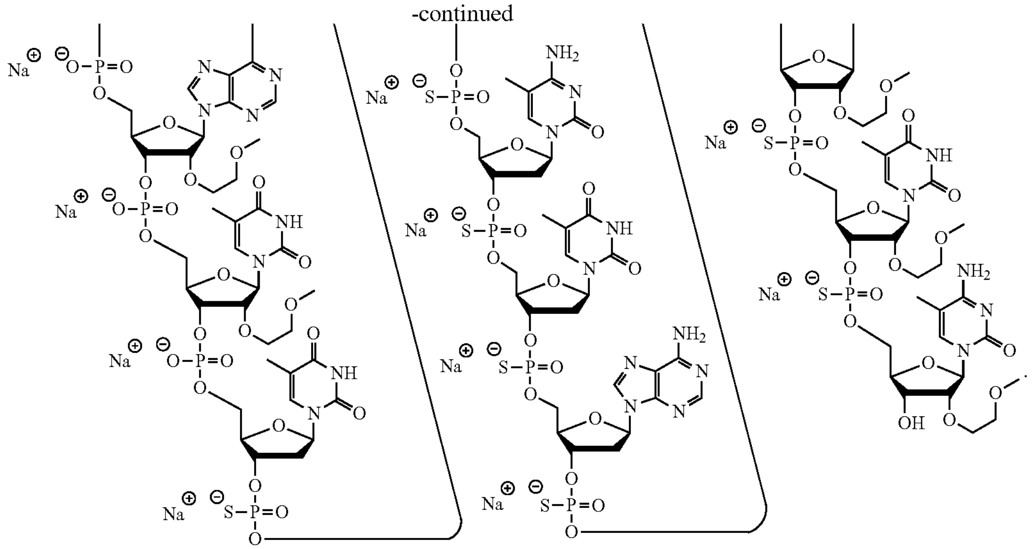
Embodiment 40: A modified oligonucleotide according to the following chemical structure:
(SEQ ID NO: 2904)
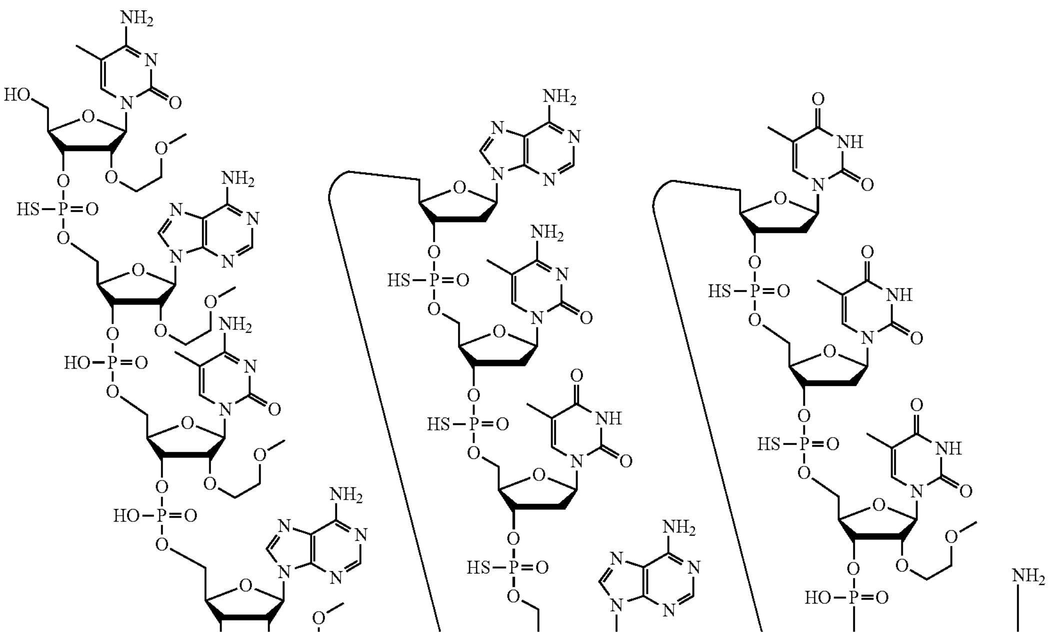

-continued
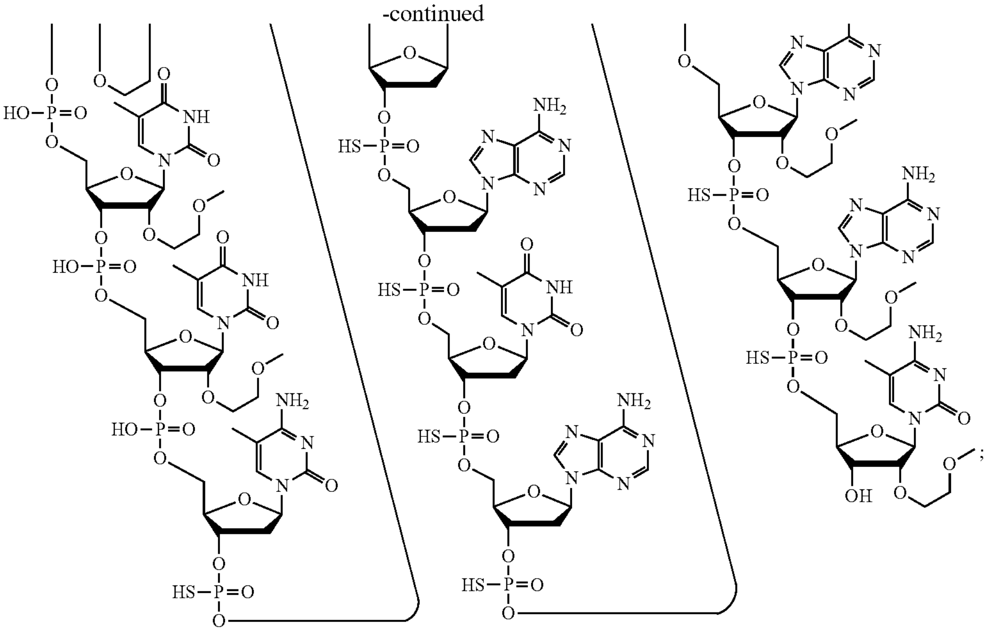
or a salt thereof.
Embodiment 47: A modified oligonucleotide according to the following chemical structure:
(SEQ ID NO: 2904)
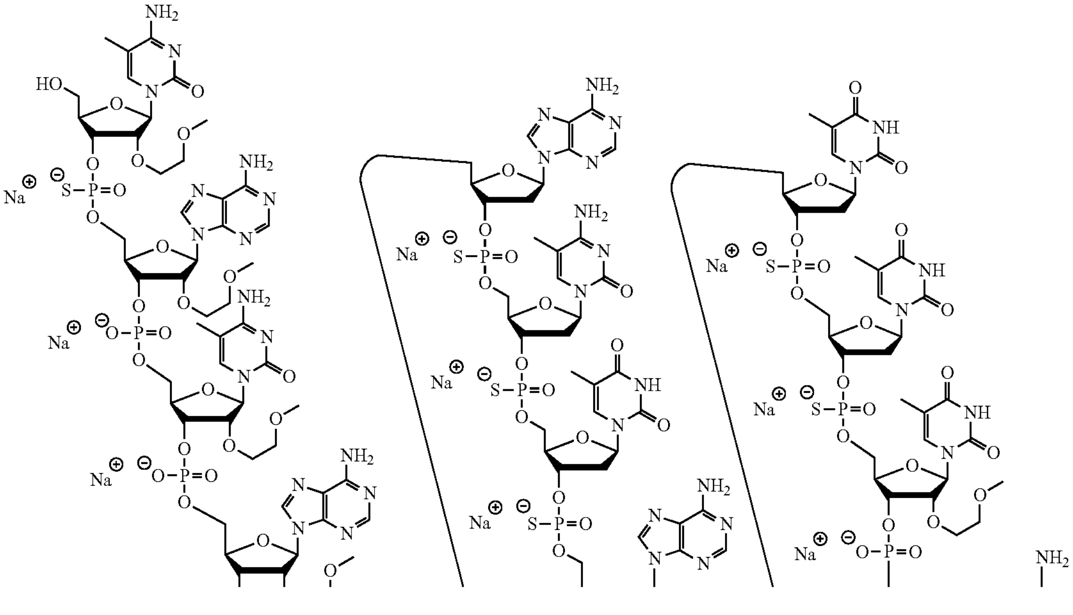

-continued
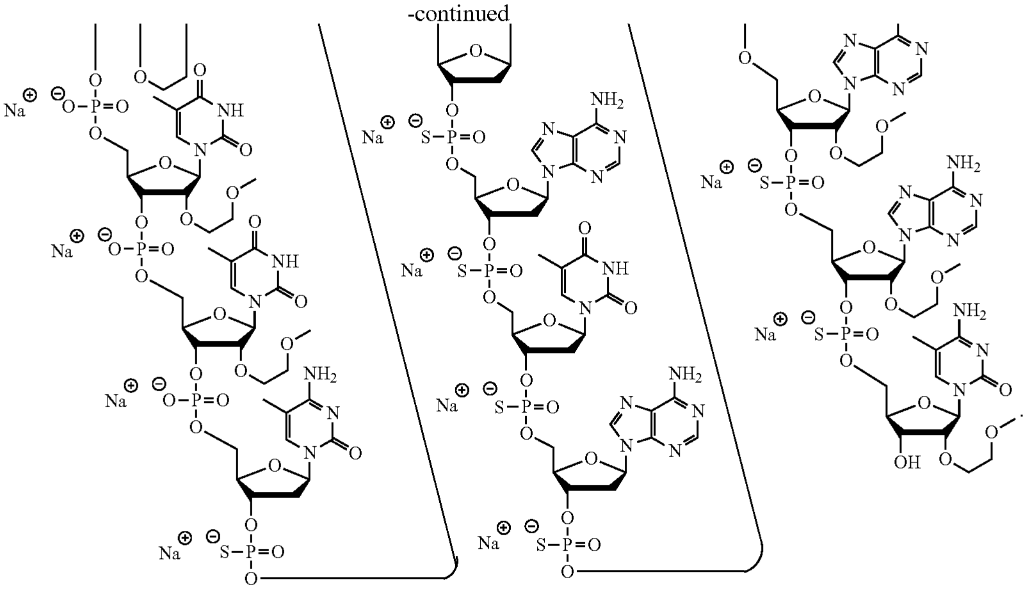
Embodiment 48: A modified of oligonucleotide according to the Mowing chemical structure:
(SEQ ID NO: 2903)
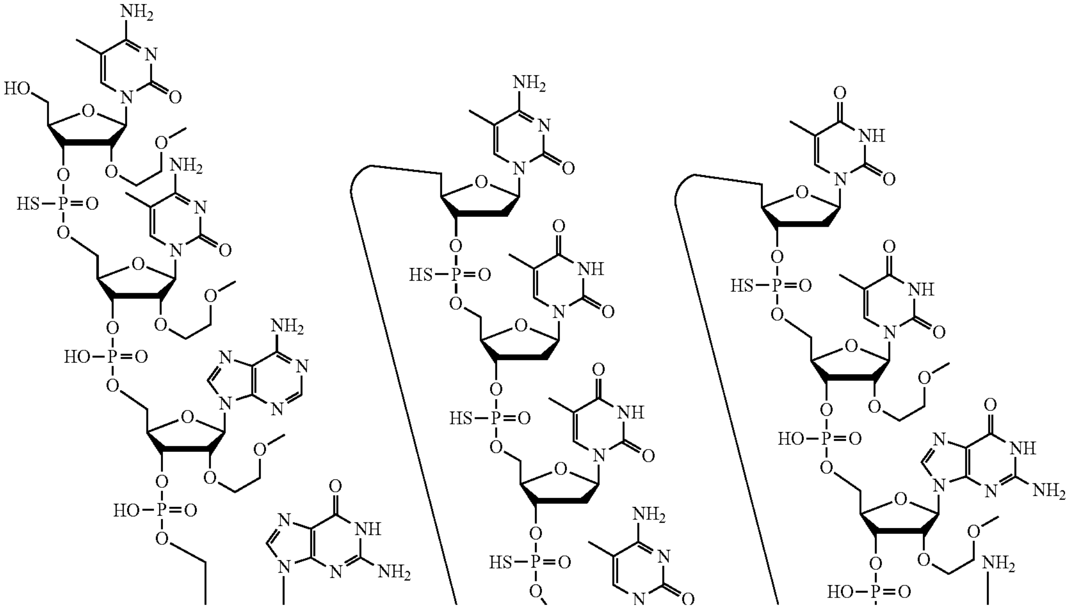

-continued
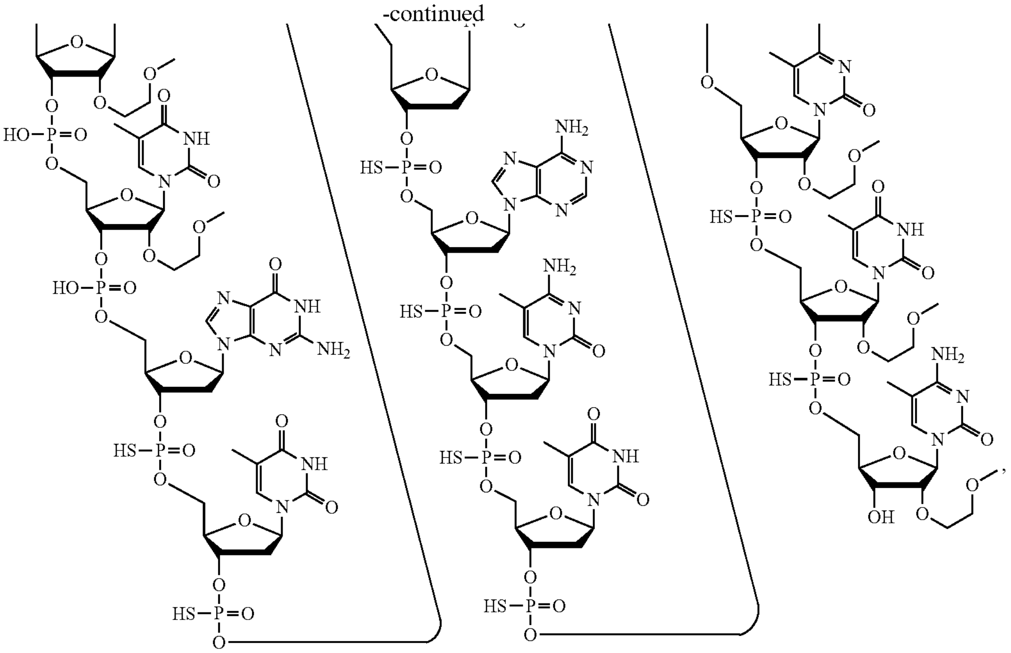
or a salt thereof.
Embodiment 49: A modified oligonucleotide according to the following chemical structure:
(SEQ ID NO: 2903)
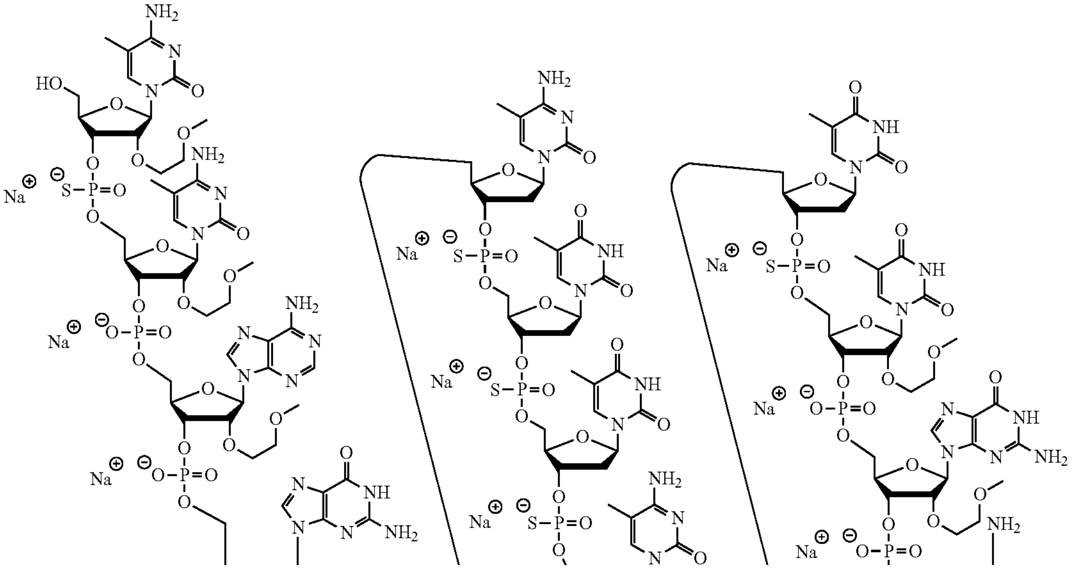

-continued
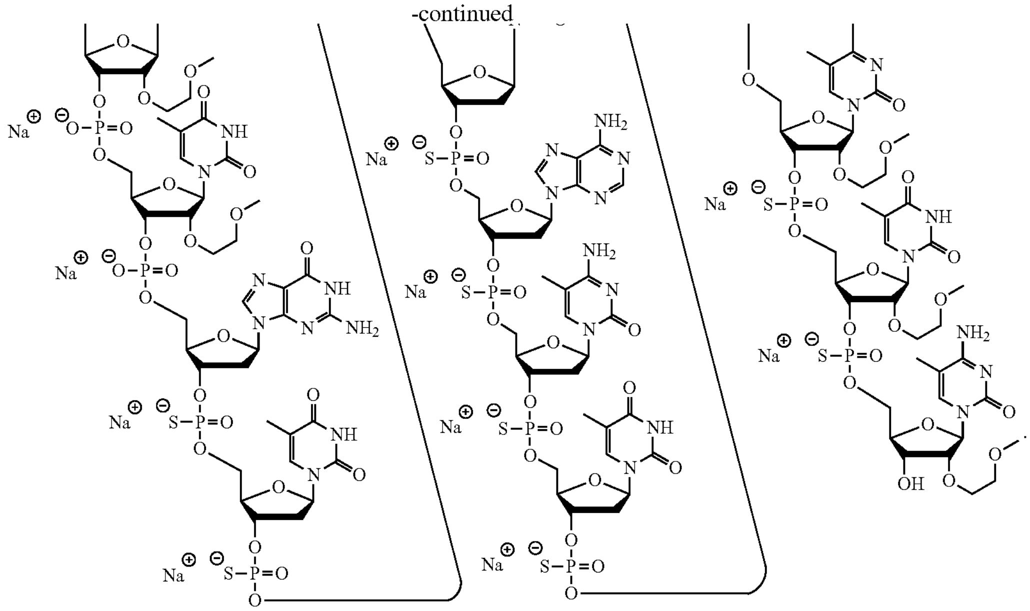
Embodiment 50: A modified oligonucleotide according to the following chemical structure:
(SEQ ID NO: 2902)
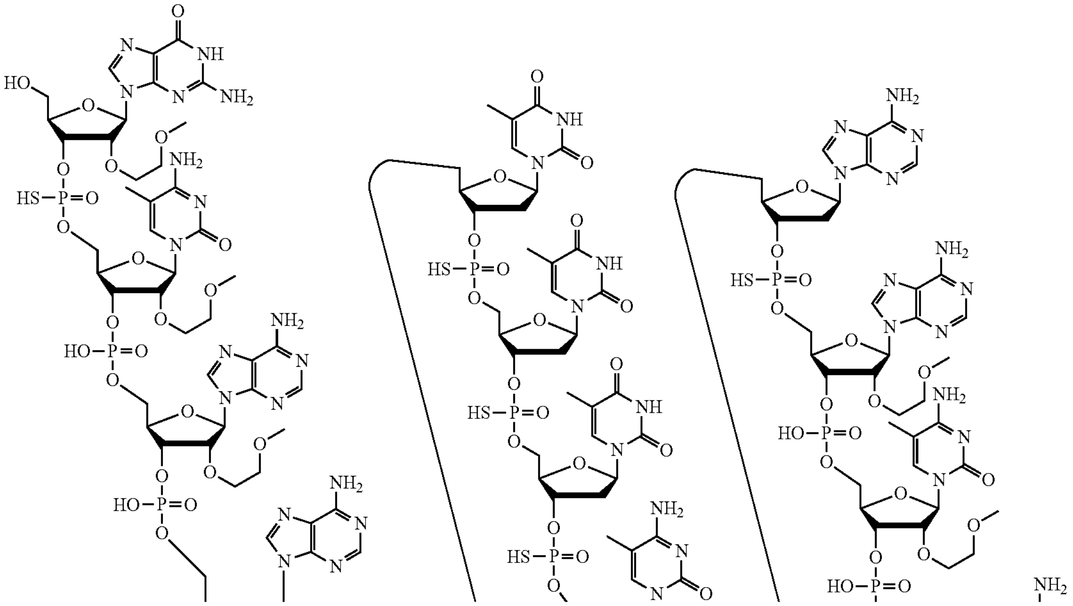

-continued
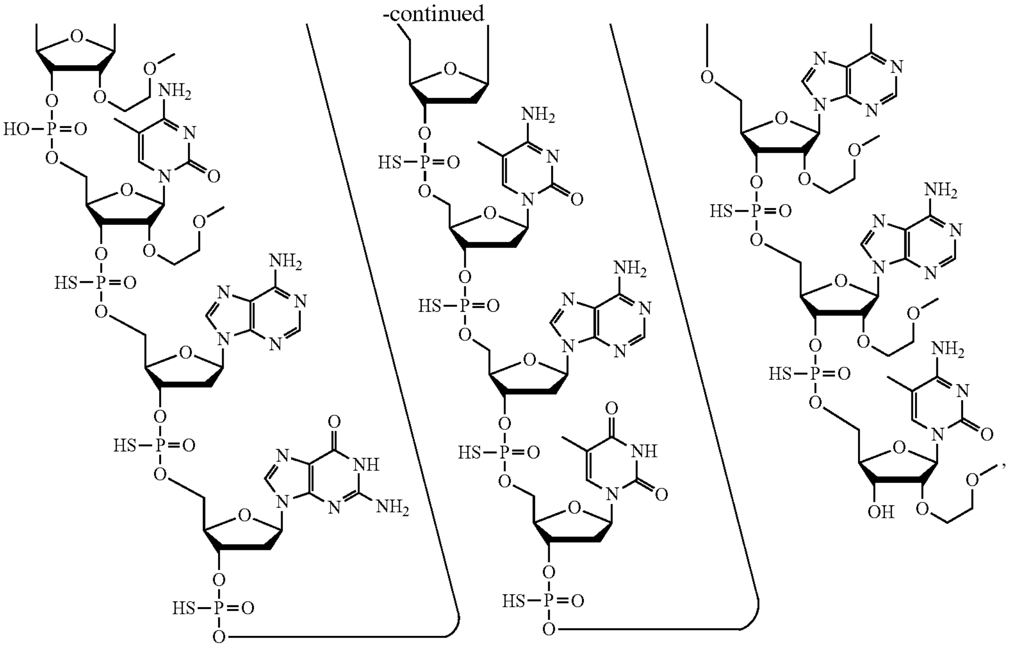
or a salt thereof.
Embodiment 51: A modified oligonucleotide according to the following chemical structure:
(SEQ ID NO: 2902)
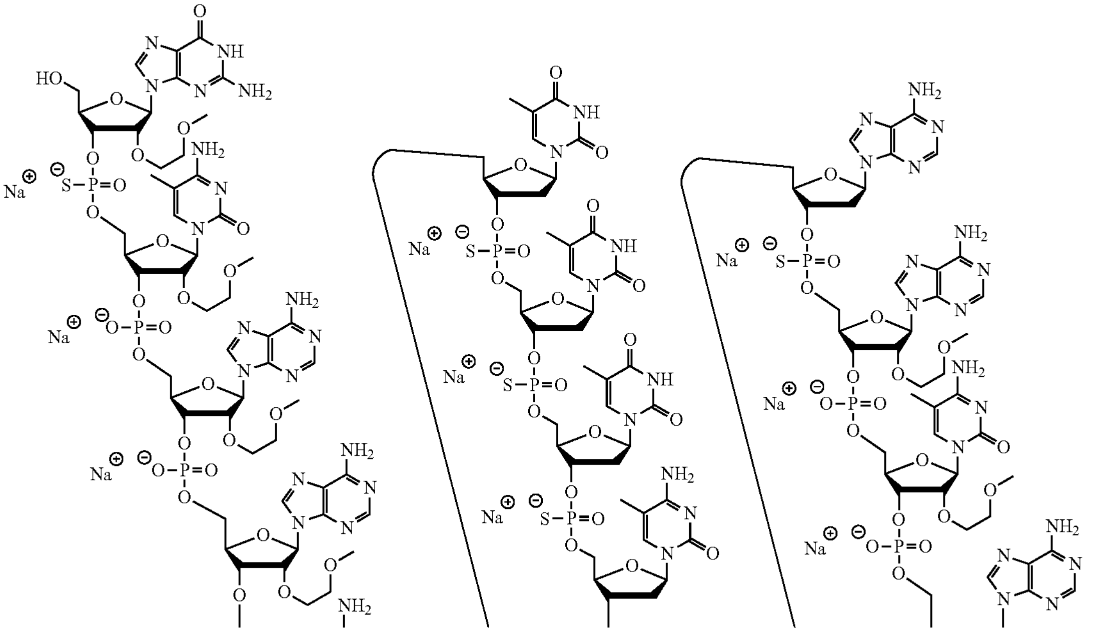

-continued
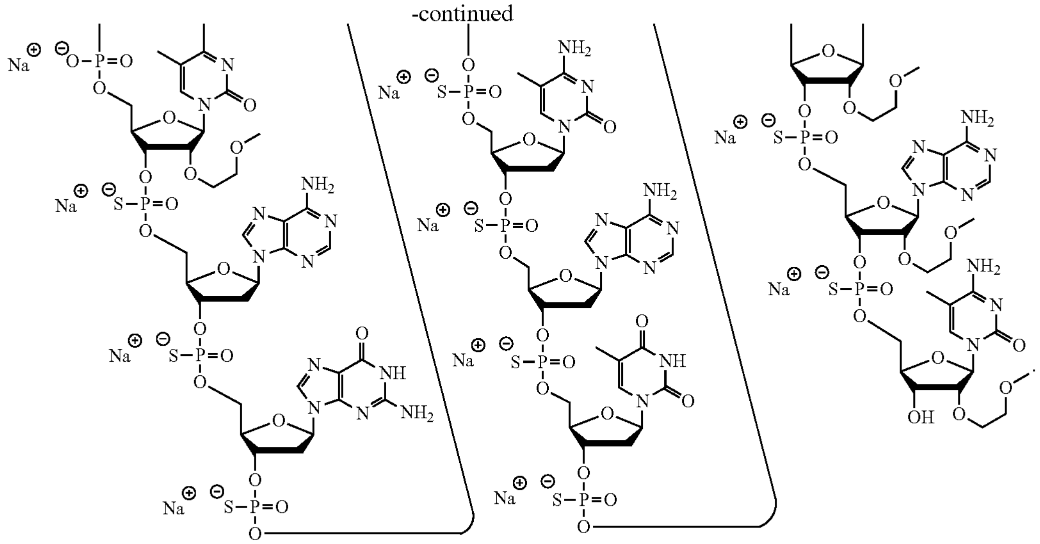
Embodiment 52: A modified oligonucleotide according to the following chemical structure:
(SEQ ID NO: 2906)
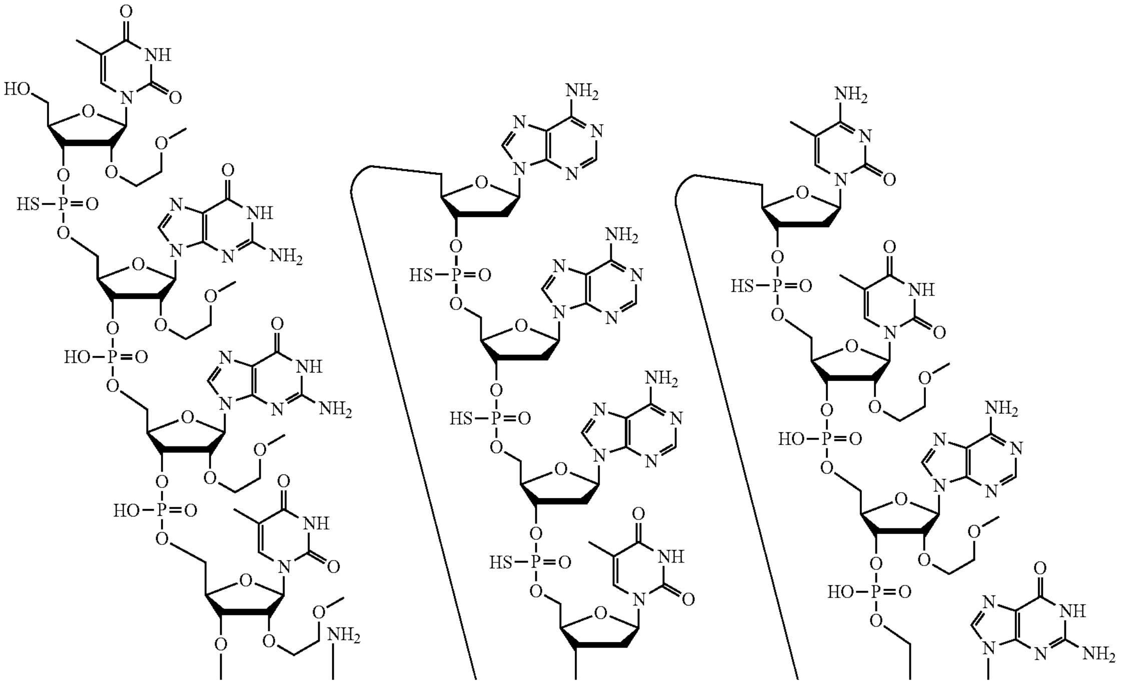

-continued
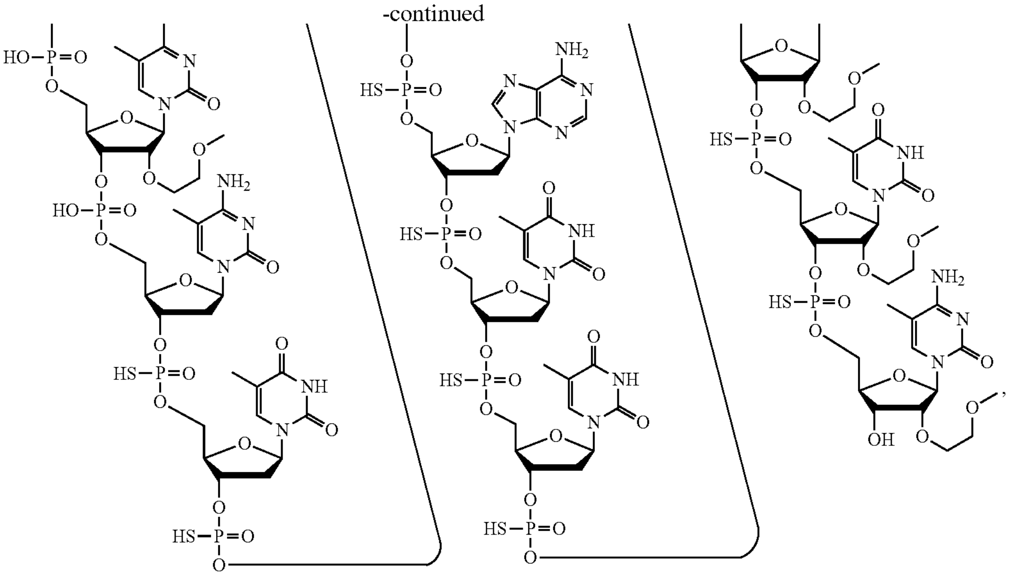
or a salt thereof.
Embodiment 53: A modified oligonucleotide according to the following chemical structure:
(SEQ ID NO: 2906)
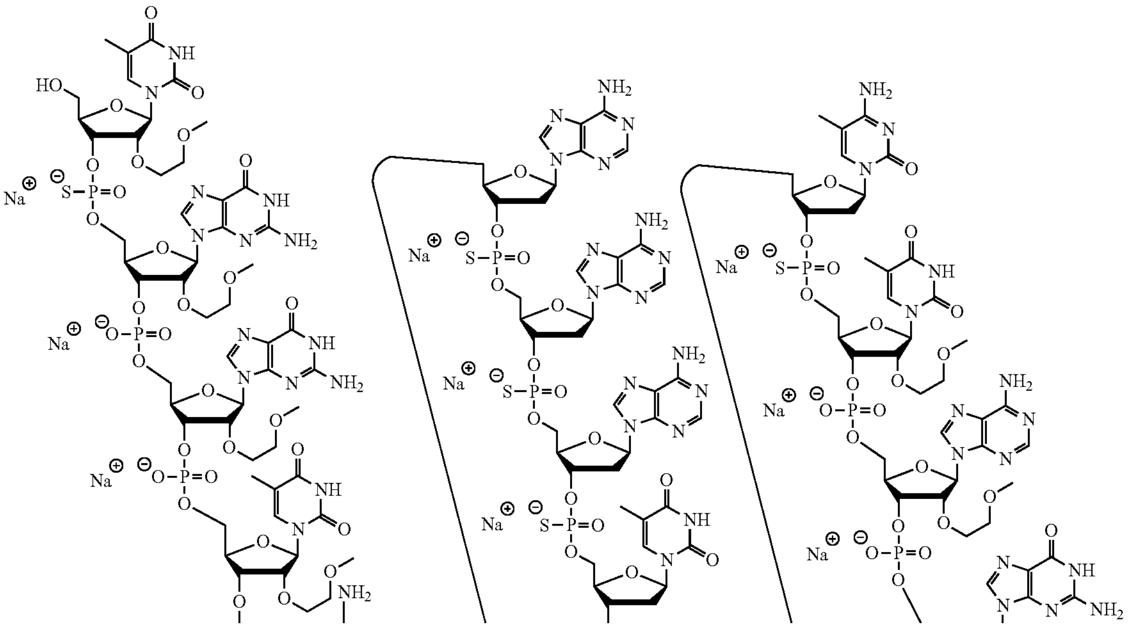

-continued
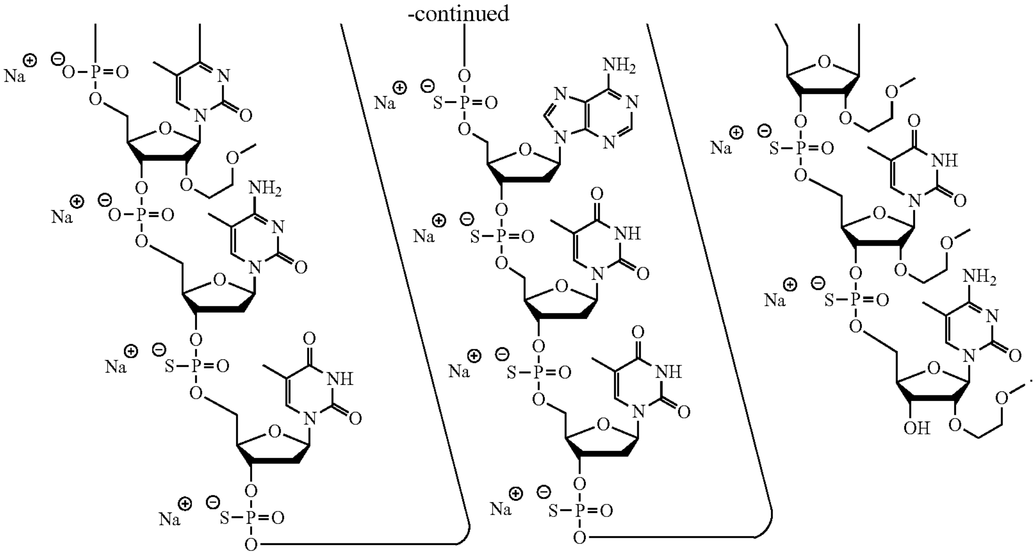
Embodiment 54: A modified oligonucleotide according to the following chemical structure:
(SEQ ID NO: 2901)
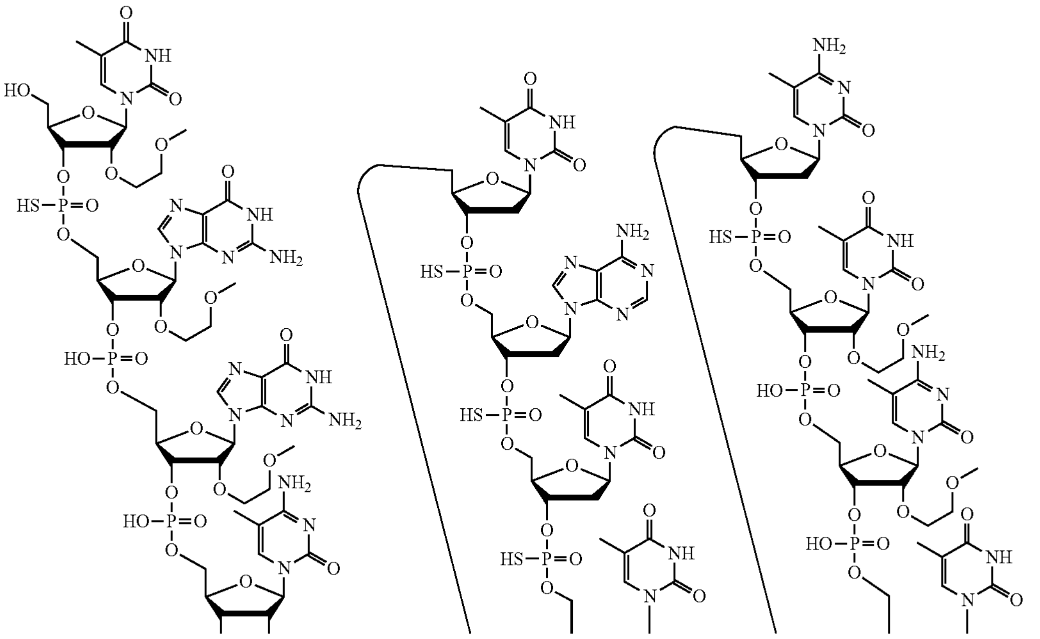

-continued
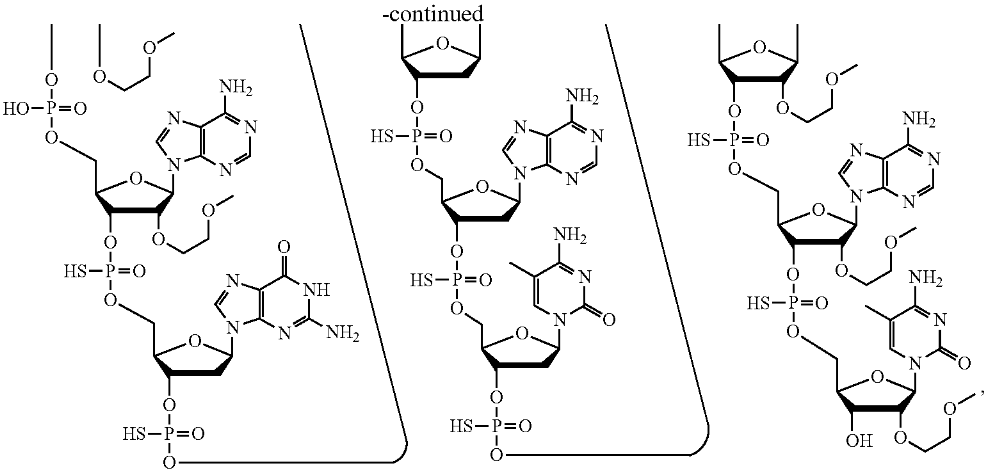
or a salt thereof.
Embodiment 55: A modified oligonucleotide according to the following chemical structure:
(SEQ ID NO: 2901)
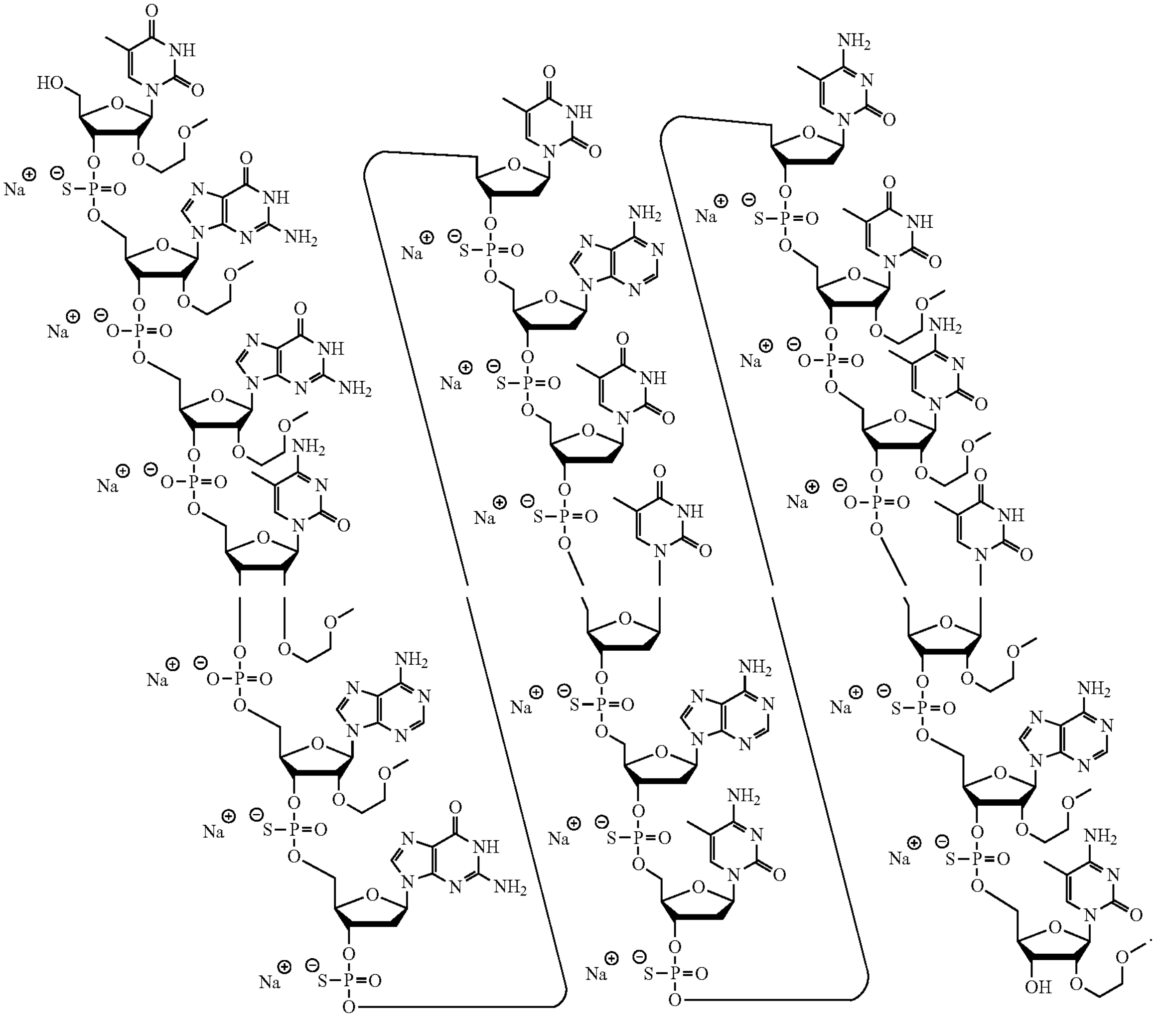

Embodiment 56: The modified oligonucleotide of any one of embodiments 44, 46, 48, 50, 52, and 54, which is the sodium salt or potassium salt of the chemical structure.

Embodiment 57: A pharmaceutical composition comprising the modified oligonucleotide ofany of embodiments 44-56 and a pharmaceutically acceptable carrier or diluent.

Embodiment 58: The pharmaceutical composition of embodiment 57, wherein the pharmaceutically acceptable diluent is artificial cerebrospinal fluid.

Embodiment 59: The pharmaceutical composition of embodiment 58, wherein the pharmaceutical composition consists of the modified oligonucleotide and artificial cerebrospinal fluid.

Embodiment 60: A compound comprising a modified oligonucleotide according to the following chemical notation: ${}^{m}C_{es}A_{eo}G_{eo}A_{eo}T_{eo}T_{ds}A_{ds}{}^{m}C_{ds}{}^{m}C_{ds}T_{ds}{}^{m}C_{ds}T_{ds}A_{ds}{}^{m}C_{ds}T_{ds}A_{eo}G_{es}T_{es}{}^{m}C_{e}$ (SEQ ID NO: 2905), wherein:

A=an adenine nucleobase, ${}^{m}C$=a 5-methylcytosine nucleobase,

G=a guanine nucleobase,

T=a thymine nucleobase, e=a 2'-β-D-MOE sugar moiety, d=a 2'-β-D-deoxyribosyl sugar moiety, s=a phosphorothioate internucleoside linkage, and o=a phosphodiester internucleoside linkage.

Embodiment 61: A compound comprising a modified oligonucleotide according to the following chemical notation: ${}^{m}C_{es}A_{eo}{}^{m}C_{eo}A_{eo}T_{eo}T_{eo}{}^{m}C_{ds}A_{ds}{}^{m}C_{ds}T_{ds}A_{ds}A_{ds}T_{ds}A_{ds}T_{ds}T_{ds}T_{eo}A_{es}A_{es}{}^{m}C_{e}$ (SEQ ID NO: 2904), wherein A=an adenine nucleobase, ${}^{m}C$=a 5-methylcytosine nucleobase, G=a guanine nucleobase, T=a thymine nucleobase, e=a 2'-β-D-MOE sugar moiety, d=a 2'-β-D-deoxyribosyl sugar moiety.

s=a phosphorothioate internucleoside linkage, and o=a phosphodiester internucleoside linkage.

Embodiment 62: A compound comprising a modified oligonucleotide according to the following chemical notation: ${}^{m}C_{es}{}^{m}C_{eo}A_{eo}G_{eo}T_{eo}G_{ds}T_{ds}{}^{m}C_{ds}T_{ds}T_{ds}{}^{m}C_{ds}A_{ds}{}^{m}C_{ds}T_{ds}T_{ds}T_{eo}G_{eo}{}^{m}C_{es}T_{es}{}^{m}C_{e}$ (SEQ ID NO: 2903), wherein:

A=an adenine nucleobase, ${}^{m}C$=a 5-methylcytosine nucleobase,

G=a guanine nucleobase,

T=a thymine nucleobase, e=a 2'-β-D-MOE sugar moiety, d=a 2'-β-D-deoxyribosyl sugar moiety, s=a phosphorothioate internucleoside linkage, and o=a phosphodiester internucleoside linkage.

Embodiment 63: A compound comprising a modified oligonucleotide according to the following chemical notation: $G_{es}{}^{m}C_{eo}A_{eo}A_{eo}{}^{m}C_{es}A_{ds}G_{ds}T_{ds}T_{ds}T_{ds}{}^{m}C_{ds}{}^{m}C_{ds}A_{ds}T_{ds}A_{ds}A_{eo}{}^{m}C_{eo}A_{es}A_{es}{}^{m}C_{e}$ (SEQ ID NO: 2902), wherein:

A=an adenine nucleobase.

${}^{m}C$=a 5-methylcytosine nucleobase,

G=a guanine nucleobase,

T=a thymine nucleobase, e=a 2'-β-D-MOE sugar moiety, d=a 2'-β-D-deoxyribosyl sugar moiety, s=a phosphorothioate internucleoside linkage, and o=a phosphodiester internucleoside linkage.

Embodiment 64: A compound comprising a modified oligonucleotide according to the following chemical notation: $T_{es}G_{eo}G_{eo}T_{eo}{}^{m}C_{eo}{}^{m}C_{ds}T_{ds}A_{ds}A_{ds}A_{ds}T_{ds}A_{ds}T_{ds}T_{ds}{}^{m}C_{ds}T_{eo}A_{eo}G_{es}T_{es}{}^{m}C_{e}$ (SEQ ID NO: 2906), wherein:

A=an adenine nucleobase.

${}^{m}C$=a 5-methylcytosine nucleobase,

G=a guanine nucleobase,

T=a thymine nucleobase, e=a 2'-β-D-MOE sugar moiety, d=a 2'-β-D-deoxyribosyl sugar moiety, s=a phosphorothioate internucleoside linkage, and o=a phosphodiester internucleoside linkage.

Embodiment 65: A compound comprising a modified oligonucleotide according to the following chemical notation: $T_{es}G_{eo}G_{eo}{}^{m}C_{eo}A_{es}G_{ds}T_{ds}A_{ds}T_{ds}T_{ds}T_{ds}A_{ds}{}^{m}C_{ds}{}^{m}C_{ds}T_{eo}{}^{m}C_{eo}T_{es}A_{es}{}^{m}C_{e}$ (SEQ ID NO: 2901), wherein:

A=an adenine nucleobase, ${}^{m}C$=a 5-methylcytosine nucleobase,

G=a guanine nucleobase,

T=a thymine nucleobase, e=a 2'-β-D-MOE sugar moiety, d=a 2'-β-D-deoxyribosyl sugar moiety.

s=a phosphorothioate internucleoside linkage, and o=a phosphodiester internucleoside linkage.

Embodiment 66: The compound of any of embodiments 60-65, comprising the modified oligonucleotide covalently linked to a conjugate group.

Embodiment 67: A pharmaceutical composition comprising a compound of any of embodiments 60-66, and a pharmaceutically acceptable diluent or carrier.

Embodiment 68: The pharmaceutical composition of embodiment 67, wherein the pharmaceutically acceptable diluent is artificial cerebrospinal fluid.

Embodiment 69: The pharmaceutical composition of embodiment 68, wherein the pharmaceutical composition consists of the compound and artificial cerebrospinal fluid.

Embodiment 70: A chirally enriched population of modified oligonucleotides of any of embodiments 60-65, wherein the population is enriched for modified oligonucleotides comprising at least one particular phosphorothioate internucleoside linkage having a particular stereochemical configuration.

Embodiment 71: The chirally enriched population of embodiment 70, wherein the population is enriched for modified oligonucleotides comprising at least one particular phosphorothioate internucleoside linkage having the (Sp) configuration.

Embodiment 72: The chirally enriched population of embodiment 70, wherein the population is enriched for modified oligonucleotides comprising at least one particular phosphorothioate internucleoside linkage having the (Sp) configuration.

Embodiment 73: The chirally enriched population of embodiment 70, wherein the population is enriched for modified oligonucleotides having a particular, independently selected stereochemical configuration at each phosphorothioate internucleoside linkage Embodiment 74: The chirally enriched population of embodiment 70, wherein the population is enriched for modified oligonucleotides having the (Sp) configuration at each phosphorothioate internucleoside linkage.

Embodiment 75: The chirally enriched population of embodiment 70, wherein the population is enriched for modified oligonucleotides having the (Rp) configuration at each phosphothioate internucleoside linkage.

Embodiment 76: The chirally enriched population of embodiment 70, wherein the population is enriched for modified oligonucleotides having the (Rp) configuration at one particular phosphorothioate internucleoside linkage and the (Sp) configuration at each of the remaining phosphorothioate internucleoside linkages.

Embodiment 77: The chirally enriched population of embodiment 70 or embodiment 73 wherein the population is enriched for modified oligonucleotides having at least 3 contiguous phosphorothioate internucleoside linkages in the Sp, Sp, and Rp configurations, in the 5' to 3' direction.

Embodiment 78: A chirally enriched population of modified oligonucleotides of any of embodiments 44-55, wherein all of the phosphorothioate internucleoside linkages of the modified oligonucleotide are stereorandom.

Embodiment 79: A method comprising administering to an individual the pharmaceutical composition of any of embodiments 56-58 and 67-69.

Embodiment 80: A method of treating a disease associated with GFAP, comprising administering to an individual having or at risk of having a disease associated with GFAP a therapeutically effective amount of the pharmaceutical composition of any one of embodiments 56-58 and 67-69, thereby treating the disease associated with GFAP.

Embodiment 81: A method of reducing GFAP protein in the CSF of an individual having or at risk of having a disease associated with GFAP a therapeutically effective amount of a pharmaceutical composition of any one of embodiments 56-58 and 67-69, thereby reducing GFAP protein in the CSF.

Embodiment 82: The method of embodiment 80 or embodiment 81, wherein the disease is a neurodegenerative disease.

Embodiment 83: The method of any of embodiments 80-82, wherein the disease is Alexander disease.

Embodiment 84: The method of any of embodiments 80-83, wherein at least one symptom or hallmark of the disease is ameliorated.

Embodiment 85: The method of embodiment 84, wherein the symptom or hallmark is any of motor delays, cognitive delays, paroxysmal deterioration, seizures, vomiting, swallowing difficulties, ataxic gait, palatal myoclonus, autonomic dysfunction, or the presence of intra-astrocytic inclusions called Rosenthal fibers.

Embodiment 86: The method of am of embodiments 79-85, wherein the pharmaceutical composition is administered to the central nervous system or systemically.

Embodiment 87: The method of embodiment 86, wherein the pharmaceutical composition is administered to the central nervous system and systemically.

Embodiment 88: The method of any of embodiments 80-87, wherein the pharmaceutical composition is administered any of intrathecally, systemically, subcutaneously, or intramuscularly.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-$OCH_3$ ("OMe" or "O-methyl"), and 2'-$O(CH_2)_2OCH$ ("MOE" or "O-methoxyethyl"). In certain embodiments, 2'-substituent groups are selected from among: halo, allyl, amino, azido, SH, CN, OCN, $CF_3$, $OCF_3$, O—$C_1$-$C_{10}$ alkoxy, O—$C_1$-$C_{10}$ substituted alkoxy, O—$C_1$-$C_{10}$ alkyl, O—$C_1$-$C_{10}$ substituted alkyl, S-alkyl, $N(R_m)$-alkyl, O-alkenyl, S-alkenyl, $N(R_m)$-alkenyl. O-alkynyl, S-alkynyl, $N(R_m)$-alkynyl, O-alkylenyl-O-alkyl, alkynyl, alkaryl, aralkyl, O-alkaryl, O-aralkyl, $O(CH_2)_2SCH_3$, $O(CH_2)_2ON(R_m)(R_n)$ or $OCH_2C(=O)—N(R_m)(R_n)$, where each $R_m$ and $R_n$ is, independently, H, an amino protecting group, or substituted or unsubstituted $C_1$-$C_{10}$ alkyl, and the 2'-substituent groups described in Cook et al. U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro ($NO_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted non-bicyclic modified nucleoside comprises a sugar moiety comprising a non-bridging 2'-substituent group selected from: F, $NH_2$, $N_3$, $OCF_3$. $OCH_3$, $O(CH_2)_3NH_2$, $CH_2CH=CH_2$, $OCH_2CH=CH_2$, $OCH_2CH_2OCH_3$, $O(CH_2)_2SCH_3$, $O(CH_2)_2ON(R_m)(R_n)$, $O(CH_2)_2O(CH_2)_2N(CH_3)_2$, and N-substituted acetamide ($OCH_2C(=O)—N(R_m)(R_n)$), where each $R_m$ and $R_n$ is, independently, H, an amino protecting group, or substituted or unsubstituted $C_1$-$C_{10}$ alkyl.

In certain embodiments, a 2'-substituted non-bicycic modified nucleoside comprises a sugar moiety comprising a non-bridging 2'-substituent group selected from: F, $OCF_3$, $OCH_3$, $OCH_2CH_2OCH_3$, $O(CH_2)_2SCH_3$, $O(CH_2)_{20}N(CH_3)_2$, $O(CH_2)_2O(CH_2)_2N(CH_3)_2$, and $OCH_2C(=O)—N(H)CH_3$ ("NMA").

In certain embodiments, a 2'-substituted non-bicyclic modified nucleoside comprises a sugar moiety comprising a non-bridging 2'-substituent group selected from: F, OCH, and $OCH_2CH_2OCH_3$.

In certain embodiments, modified furanosyl sugar moieties and nucleosides incorporating such modified furanosyl sugar moieties are further defined by isomeric configuration.

For example, a 2'-deoxyfuranosyl sugar moiety may be in seven isomeric configurations other than the naturally occurring pi-D-deoxyribosyl configuration. Such modified sugar moieties are described in, e.g., WO 2019/157531, incorporated by reference herein. A 2'-modified sugar moiety has an additional stereocenter at the 2'-position relative to a 2'-deoxyfuranosyl sugar moiety; therefore, such sugar moieties have a total of sixteen possible isomeric configurations, 2'-modified sugar moieties described herein are in the 1-D-ribosyl isomeric configuration unless otherwise specified.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-$CH_2$-2', 4'-$(CH_2)_2$-2', 4'-$(CH_2)_3$-2', 4'-$CH_2$—O-2' ("LNA"), 4'-$CH_2$—S-2', 4'-$(CH_2)_2$—O-2' ("ENA"), 4'-$CH(CH_3)$—O-2' (referred to as "constrained ethyl" or "cEt"), 4'-$CH_2$—$CH_2$-2', 4'-$CH_2$—N(R)-2', 4'-CH $(CH_2OCH_3)$-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-$C(CH_3)(CH_3)$—O-2' and analogs thereof (see, e.g., Seth et al., U.S. Pat. No. 8,278,283), 4'-$CH_2$—$N(OCH_3)$-2' and analogs thereof (see, e.g., Prakash et al., U.S. Pat. No. 8,278,425), 4'-$CH_2$—O—$N(CH_3)$-2' (see, e.g., Allerson et al., U.S. Pat. No. 7,696,345 and Allerson et al., U.S. Pat. No. 8,124,745), 4'-$CH_2$—$C(H)(CH_3)$-2' (see, e.g., Zhou, et al., *J. Org. Chem.,* 2009, 74, 118-134), 4'-$CH_2$—$C(=CH_2)$-2' and analogs thereof (see e.g., Seth et al., U.S. Pat. No. 8,278,426), 4'-$C(R_aR_b)$—N(R)—O-2', 4'-$C(R_aR_b)$—O—N(R)-2', 4'-$CH_2$—O—N(R)-2', and 4'-$CH_2$—N(R)—O-2', wherein each R, $R_a$, and $R_b$ is, independently, H, a protecting group, or $C_1$-$C_{12}$ alkyl (see, e.g. Imanishi et al., U.S. Pat. No. 7,427,672).

In certain embodiments, such 4' to 2' bridges independently comprise from 1 to 4 linked groups independently selected from: —$[C(R_a)(R_b)]_n$—, —$[C(R_a)(R_b)]_n$—O—, —$C(R_a)$=$C(R_b)$C—, $C(R_a)$=N—, —C(=$NR_a$)—, —C(=O)—, —C(=S)—, —O—, —$Si(R_a)_2$—, —$S(=O)_x$—, and —$N(R_a)$—;

wherein:

x is 0, 1, or 2;

n is 1, 2, 3, or 4;

each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$alicyclic radical, halogen, $OJ_1$, $NJ_1J_2$, $SJ_1$, $N_3$, $COOJ_1$, acyl (C(=O)—H), substituted acyl, CN, sulfonyl $(S(=O)_2$-$J_1)$, or sulfoxy (S(=O)-$J_1$); and each $J_1$ and $J_2$ is, independently. H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., *Nucleic Acids Research,* 1997, 25(22), 44294443, Albaek et al., *J. Org. Chem.,* 2006, 71, 7731-7740, Singh et al. *Chem. Commun.,* 1998, 4, 455-456: Koshkin et al., *Tetrahedron,* 1998, 54, 3607-3630; Kumar et al., *Bioorg. Med. Chem. Lett.,* 1998, 8, 2219-2222; Singh et al., *J. Org. Chem.,* 1998, 63, 10035-10039: Srivastava et al., *J. Am. Chem. Soc.,* 2007, 129, 8362-8379; Wengel et al. U.S. Pat. No. 7,053,207: Imanishi et al., U.S. Pat. No. 6,268,490; Imanishi et al. U.S. Pat. No. 6,770,748; Imanishi et al. U.S. RE44,779: Wengel et al., U.S. Pat. No. 6,794,499; Wengel et al., U.S. Pat. No. 6,670,461: Wengel et al., U.S. Pat. No. 7,034,133; Wengel et al., U.S. Pat. No. 8,080,644; Wengel et al., U.S. Pat. No. 8,034,909: Wengel et al. U.S. Pat. No. 8,153,365: Wengel et al., U.S. Pat. No. 7,572,582; Ramasamy et al. U.S. Pat. No. 6,525,191; Torsten et al., WO 2004/106356; Wengel et al., WO 1999/014226; Seth et al. WO 2007/134181; Seth et al., U.S. Pat. No. 7,547,684; Seth et al. U.S. Pat. No. 7,666,854; Seth et al., U.S. Pat. No. 8,088,746; Seth et al. U.S. Pat. No. 7,750,131: Seth et al., U.S. Pat. No. 8,030,467; Seth et al., U.S. Pat. No. 8,268,980: Seth et al., U.S. Pat. No. 8,546,556; Seth et al., U.S. Pat. No. 8,530,640; Migawa et al. U.S. Pat. No. 9,012,421: Seth et al. U.S. Pat. No. 8,501,805; and U.S. Patent Publication Nos. Allerson et al. US2008/0039618 and Migawa et al. US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

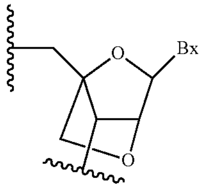

LNA (β-D-configuration) bridge = 4'-$CH_2$—O-2'

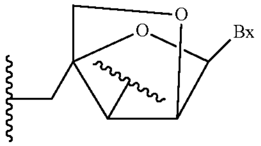

*α*-L-LNA (α-L-configuration) bridge = 4'-$CH_2$—O-2'

α-L-methyleneoxy (4'-$CH_2$—O-2') or α-L-LNA bicyclic nucleosides have been incorporated into oligonucleotides that showed antisense activity (Frieden et al., *Nucleic Acid Research,* 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see. e.g., Bhat et al. U.S. Pat. No. 7,875,733 and Bhat et al. U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

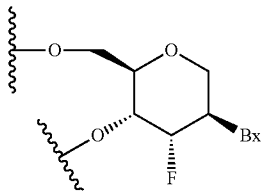

F-HNA ("F-HNA", see e.g. Swayze et al., U.S. Pat. No. 8,088,904; Swayze et al. U.S. Pat. No. 8,440,803; Swayze et al. U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

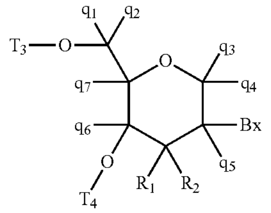

wherein, independently, for each of the modified THP nucleosides:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H.

In certain embodiments, at least one of $q_1$, $q_2$, $q_3$, $q_4$, $q_5$, $q_6$ and $q_7$ is other than H, In certain embodiments, at least one of $q_1$, $q_2$, $q_3$, $q_4$, $q_5$, $q_6$ and $q_7$ is methyl. In certain embodiments, modified THP nucleosides are provided wherein one of R, and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al. Biochemistry, 2002, 41, 45034510 and Summerton et al., U.S. Pat. No. 5,698,685; Summerton et al., U.S. Pat. No. 5,166,315; Summerton et al. U.S. Pat. No. 5,185,444; and Summerton et al., U.S. Pat. No. 5,034,506). As used here, the term "morpholino" means a sugar surrogate having the following structure:

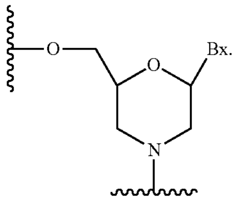

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.*, 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleosides comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2. N-6 and O-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl ($-C\equiv C-CH_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrvlguanine, 4-N-benzoylcytosine, 4-N-benzoyluracil, 5-methyl 4-N-benzoylcytosine, 5-methyl 4-N-benzoylumcil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp).

Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz J. I., Ed., John Wiley & Sons, 1990, 858-859: Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442443.

Publications that teach the preparation of certain of the above noted modified nucleobases as well as other modified nucleobases include without limitation. Manoharan et al., US2003/0158403; Manoharan et al. US2003/0175906; Dinh et al., U.S. Pat. No. 4,845,205: Spielvogel et al., U.S. Pat. No. 5,130,302; Rogers et al. U.S. Pat. No. 5,134,066; Bischofberger et al., U.S. Pat. No. 5,175,273: Urdea et al., U.S. Pat. No. 5,367,066: Benner et al. U.S. Pat. No. 5,432, 272: Matteucci et al. U.S. Pat. No. 5,434,257: Gmeiner et al., U.S. Pat. No. 5,457,187; Cook et al., U.S. Pat. No. 5,459, 255; Froehler et al., U.S. Pat. No. 5,484,908; Matteucci et al., U.S. Pat. No. 5,502,177; Hawkins et al. U.S. Pat. No. 5,525,711; Haralambidis et al., U.S. Pat. No. 5,552,540; Cook et al., U.S. Pat. No. 5,587,469; Froehler et al. U.S. Pat. No. 5,594,121: Switzer et al. U.S. Pat. No. 5,596,091; Cook et al., U.S. Pat. No. 5,614,617; Froehler et al., U.S. Pat. No. 5,645,985: Cook et al., U.S. Pat. No. 5,681,941; Cook et al., U.S. Pat. No. 5,811,534: Cook et al., U.S. Pat. No. 5,750, 692; Cook et al., U.S. Pat. No. 5,948,903: Cook et al., U.S. Pat. No. 5,587,470; Cook et al., U.S. Pat. No. 5,457,191: Matteucci et al., U.S. Pat. No. 5,763,588: Froehler et al., U.S. Pat. No. 5,830,653; Cook et al., U.S. Pat. No. 5,808, 027: Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphodiesters, which contain a phosphodiester bond ("$P(O_2)=O$") (also referred to as unmodified or naturally occurring linkages), phosphotriesters, methylphosphonates, phosphoramidates, phosphorothioates ("$P(O_2)=S$"), and phosphorodithioates ("HS—P=S"). Representative non-phosphorus containing internucleoside linking groups include but are not limited to methylenemethylimino ($—CH_2—N(CH_3)—O—CH_2—$), thiodiester, thionocarbamate ($—O—C(=O)(NH)—S—$); siloxane ($—O—SiH_2—O—$); and N,N'-dimethylhydrazine ($—CH_2—N(CH_3)—N(CH_3)—$). Modified internucleoside linkages, compared to naturally occurring phosphodiester internucleoside linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate internucleoside linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate internucleoside linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkage in a particular, independently selected stereochemical configuration. In certain embodiments, the particular configuration of the particular phosphorothioate internucleoside linkage is present in at least 65% of the molecules in the population. In certain embodiments, the particular configuration of the particular phosphorothioate internucleoside linkage is present in at least 70% of the molecules in the population. In certain embodiments, the particular configuration of the particular phosphorthioate internucleoside linkage is present in at least 80% of the molecules in the population. In certain embodiments, the particular configuration of the particular phosphorothioate internucleoside linkage is present in at least 90% of the molecules in the population. In certain embodiments, the particular configuration of the particular phosphorothioate internucleoside linkage is present in at least 99% of the molecules in the population. Such chirally enriched populations of modified oligonucleotides can be generated using synthetic methods known in the art. e.g., methods described in Oka et al., *JACS* 125, 8307 (2003). Wan et al. *Nuc. Acid. Res.* 42, 13456 (2014), and WO 2017/015555. In certain embodiments, a population of modified oligonucleotides is enriched for modified oligonucleotides having at least one indicated phosphoothioate in the (Sp) configuration. In certain embodiments, a population of modified oligonucleotides is enriched for modified oligonucleotides having at least one phosphothioate in the (Rp) configuration. In certain embodiments, modified oligonucleotides comprising (Rp) and/or (Sp) phosphorothioates comprise one or more of the following formulas, respectively, wherein "B" indicates a nucleobase:

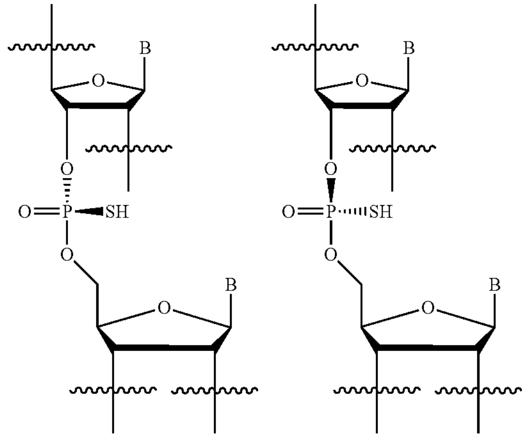

($R_p$) ($S_p$)

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates. MMI (3'-$CH_2$—$N(CH_3)$—O-5'), amide-3 (3'-$CH_2$—C(═O)—N(H)-5), amide 4 (3'-$CH_2$—N(H)—C(═O)-5'), formacetal (3'-O—$CH_2$—O-5'), methoxypropyl (MOP), and thioformacetal (3'-S—$CH_2$—O-5'). Further neutral internucleoside linkages include nonionic linkages comprising siloxane (di alkylsiloxane), carboxylate ester, carboxamide, sulfide, sulfonate ester and amides (see for example: *Carbohydrate Modifications in Antisense Research*; Y. S. Sanghvi and P. D. Cook, Eds., ACS Symposium Series 580: Chapters 3 and 4, 40-65). Further neutral internucleoside linkages include nonionic linkages comprising mixed N, O, S and $CH_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or portion thereof in a defined pattern or sugar motif. In certain instances, such sugar motifs include but are not limited to any of the sugar modifications discussed herein.

In certain embodiments, modified oligonucleotides have a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap.

Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-6 nucleosides. In certain embodiments, each nucleoside of each wing of a gapmer comprises a modified sugar moiety. In certain embodiments, at least one nucleoside of each wing of a gapmer comprises a modified sugar moiety. In certain embodiments, at least two nucleosides of each wing of a gapmer comprises a modified sugar moiety. In certain embodiments, at least three nucleosides of each wing of a gapmer comprises a modified sugar moiety. In certain embodiments, at least four nucleosides of each wing of a gapmer comprises a modified sugar moiety. In certain embodiments, at least five nucleosides of each wing of a gapmer comprises a modified sugar moiety.

In certain embodiments, the gap of a gapmer comprises 7-12 nucleosides. In certain embodiments, each nucleoside of the gap of a gapmer comprises a 2-deoxyribosyl sugar moiety. In certain embodiments, each nucleoside of the gap of a gapmer comprises a 2'-β-D-deoxyribosyl sugar moiety. In certain embodiments, at least one nucleoside of the gap of a gapmer comprises a modified sugar moiety. In certain embodiments, at least one nucleoside of the gap of a gapmer comprises a 2'-OMe sugar moiety.

In certain embodiments, the gapmer is a deoxy gapmer. In certain embodiments, the nucleosides on the gap side of each wing/gap junction comprise 2'-β-D-deoxyribosyl sugar moieties and the nucleosides on the wing sides of each wing/gap junction comprise modified sugar moieties. In certain embodiments, each nucleoside of the gap comprises a 2-deoxyribosyl sugar moiety. In certain embodiments, each nucleoside of each wing of a gapmer comprises a modified sugar moiety. In certain embodiments, one nucleoside of the gap comprises a modified sugar moiety and each remaining nucleoside of the gap comprises a 2-deoxyribosyl sugar moiety.

In certain embodiments, modified oligonucleotides comprise or consist of a portion having a fully modified sugar motif. In such embodiments, each nucleoside of the fully modified portion of the modified oligonucleotide comprises a modified sugar moiety. In certain embodiments, each nucleoside of the entire modified oligonucleotide comprises a modified sugar moiety. In certain embodiments, modified oligonucleotides comprise or consist of a portion having a fully modified sugar motif, wherein each nucleoside within the fully modified portion comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified oligonucleotide comprises the same 2'-modification.

Herein, the lengths (number of nucleosides) of the three regions of a gapmer may be provided using the notation [# of nucleosides in the 5'-wing]-[# of nucleosides in the gap]-[# of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in each sugar moiety of each wing and the gap nucleosides comprises a 2'-β-D-deoxyribosyl sugar moiety. Thus, a 5-10-5 MOE gapmer consists of 5 linked 2'-MOE nucleosides in the 5'-wing, 10 linked 2'-β-D-deoxynucleosides in the gap, and 5 linked 2'-MOE nucleosides in the 3'-wing. A 3-10-3 cEt gapmer consists of 3 linked cEt nucleosides in the 5'-wing, 10 linked 2'-β-D-deoxynucleosides in the gap, and 3 linked cEt nucleosides in the 3'-wing. A 5-8-5 gapmer consists of 5 linked nucleosides comprising a modified sugar moiety in the 5'-wing, 8 linked 2'-deoxynucleosides in the gap, and 5 linked nucleosides comprising a modified sugar moiety in the 3'-wing. A mixed wing gapmer has at least two different modified sugars in the 5' and/or 3' wing. A 5-8-5 or 5-8-4 mixed wing gapmer has at least two different modified sugar moieties in the 5'- and/or the 3'-wing.

In certain embodiments, modified oligonucleotides are 5-10-5 MOE gapmers. In certain embodiments, modified oligonucleotides are 4-10-6 MOE gapmers. In certain embodiments, modified oligonucleotides are 6-10-4 MOE gapmers. In certain embodiments, modified oligonucleotides are 5-8-5 MOE gapmers. In certain embodiments, modified oligonucleotides are X-Y-Z MOE gapmers, wherein X and Z are independently selected from 1, 2, 3, 4, 5, or 6 and Y is 7, 8, 9, 10, or 11.

In certain embodiments, modified oligonucleotides have the following sugar motif (5' to 3'): meeemddddddddddnmmmmm, wherein 'd' represents a 2'-deoxyribosyl sugar moiety, 'e' represents a 2'-MOE sugar moiety, and 'in' represents a 2'-OMe sugar moiety.

2. Certain Nucleobase Motifs

In certain embodiments, oligonucleotides comprise modified and/or unmodified nucleobases arranged along the oligonucleotide or portion thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines. In certain embodiments, all of the cytosine nucleobases are 5-methylcytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of the nucleoside is a 2'-deoxyribosyl sugar moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P═O). In certain embodiments, each internucleoside linking group of a modified oligonucleotide is a phosphorothioate internucleoside linkage (P═S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate, a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester internucleoside linkage is not a terminal internucleoside linkage, and the remaining internucleoside linkages are phosphorothioate internucleoside linkages. In certain such embodiments, all of the phosphorothioate internucleoside linkages are stereorandom. In certain embodiments, all of the phosphorothioate internucleoside linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

In certain embodiments, modified oligonucleotides have an internucleoside linkage motif of sooosssssssssssooss, wherein each "s" represents a phosphorothioate internucleoside linkage and each "o" represents a phosphodiester internucleoside linkage. In certain embodiments, modified oligonucleotides have an internucleoside linkage motif of (5' to 3'): soooosssssssssssoss, wherein each "s" represents a phosphorothioate internucleoside linkage and each "o" represents a phosphodiester internucleoside linkage. In certain embodiments, modified oligonucleotides have an internucleoside linkage motif of (5' to 3'): soooossssssssssooss, wherein each "s" represents a phosphorothioate internucleoside linkage and each "o" represents a phosphodiester internucleoside linkage. In certain embodiments, modified oligonucleotides have an internucleoside linkage motif of (5' to 3'):sooossssssssssooss, wherein each "s" represents a phosphorothioate internucleoside linkage and each "o" represents a phosphodiester internucleoside linkage.

In certain embodiments, modified oligonucleotides have an internucleoside linkage motif of (5' to 3'): sooosssssssssoooss, wherein each "s" represents a phosphorothioate internucleoside linkage and each "o" represents a phosphodiester internucleoside linkage. In certain embodiments, modified oligonucleotides have an internucleoside linkage motif of (5' to 3'): sooossssssssssssssss, wherein each "s" represents a phosphorothioate internucleoside linkage and each "o" represents a phosphodiester internucleoside linkage.

C. Certain Lengths

It is possible to increase or decrease the length of an oligonucleotide without eliminating activity. For example, in Woolf et al. Proc. Natl. Acad. Sci. USA 89:7305-7309, 1992) a series of oligonucleotides 13-25 nucleobases in length were tested for their ability to induce cleavage of a target nucleic acid in an oocyte injection model. Oligonucleotides 25 nucleobases in length with 8 or 11 mismatch bases near the ends of the oligonucleotides were able to direct specific cleavage of the target nucleic acid, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50: provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

D. Certain Modified Oligonucleotides

In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for i-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a portion of an oligonucleotide has a nucleobase sequence that is complementary to a second oligonucleotide or an identified reference nucleic acid, such as a target nucleic acid. In certain embodiments, the nucleobase sequence of a portion or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, abasic nucleosides, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc.

Natl. Acad. Sci. USA, 1989, 86, 6553-6556), cholic acid (Manoharan et al., *Bioorg. Med Chem. Lett.,* 1994, 4, 1053-1060), a thioether, e.g., hexyl-S-tritylthiol (Manoharan et al., *Ann. N.Y. Acad Sci.,* 1992, 660, 306-309: Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e.g., do-decan-diol or undecyl residues (Saison-Behmoards et al., *EMBO J.*, 1991, 10, 1111-1118; Kabanov et al., *FEBS Lett.*, 1990, 259, 327-330; Svinarchuk et al. *Biochimie*, 1993, 75, 49-54), a phospholipid, e.g., di-hexadecyl-rac-glycerol or triethyl-ammonium 1,2-di-O-hexadecyl-mc-glycero-3-H-phosphonate (Manoharan et al. *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic acid a palmityl moiety (Mishra et al., *Biochim. Biophys. Acta*, 1995, 1264, 229-237), an octadecylamine or hexylamino-carbonyl-oxycholesterol moiety (Crooke et al. *J. Pharmacol. Exp. Ther.*, 1996, 277, 923-937), a tocopherol group (Nishina et al., *Molecular Therapy Nucleic Acids*, 2015, 4, e220; and Nishina et al., *Molecular Therapy*, 2008, 16, 734-740), or a GalNAc cluster (e.g., WO2014/179620).

In certain embodiments, conjugate groups may be selected from any of a C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl.

In certain embodiments, conjugate groups may be selected from any of C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, and C5 alkyl, where the alkyl chain has one or more unsaturated bonds.

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, lipophilic groups, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active dung substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties. e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate or phosphodiester internucleoside linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxynucleoside that is attached to either the 3' or 5'-terminal nucleoside of an oligonucleotide by a phosphodiester internucleoside linkage and covalently attached to the remainder of the conjugate linker or conjugate moiety by a phosphate or phosphorothioate internucleoside linkage. In certain such embodiments, the cleavable moiety is 2'-deoxyadenosine.

3. Cell-Targeting Moieties

In certain embodiments, a conjugate group comprises a cell-targeting moiety. In certain embodiments, a conjugate group has the general formula:

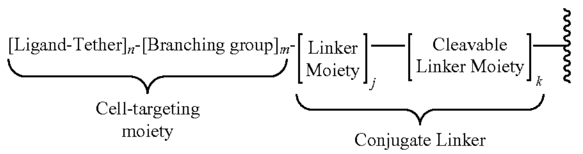

wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group. In certain embodiments, cell-targeting moieties comprise three tethered ligands covalently attached to a branching group.

B. Certain Terminal Groups

In certain embodiments, oligomeric compounds comprise one or more terminal groups. In certain such embodiments, oligomeric compounds comprise a stabilized 5'-phosphate. Stabilized 5'-phosphates include, but are not limited to 5'-phosphonates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a portion complementary to a target nucleic acid and a second oligomeric compound having a portion complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybrdization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or subject.

V. Certain Target Nucleic Acids

In certain embodiments, oligomeric compounds comprise or consist of an oligonucleotide comprising a portion that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target nucleic acid is a mature mRNA. In certain embodiments, the target nucleic acid is a pre-mRNA. In certain embodiments, the target region is entirely within an intron. In certain embodiments, the target region spans an intron/exon junction. In certain embodiments, the target region is at least 50% within an intron.

A. Complementarity/Mismatches to the Target Nucleic Acid

It is possible to introduce mismatch bases without eliminating activity. For example, Gautschi et al (J. Natl. Cancer Inst, 93:463471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and a 28- and 42-nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a portion that is 00%, or fully complementary to a target nucleic acid. In certain embodiments, the portion of full complementarity is 6, 7, 8, 9, 10, 11, 12, 13, 14, 15, 16, 17, 18, 19, 20, 21, 22, 23, or 24 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, 8, 9, 10, or 11 from the 5'-end of the gap region. In certain embodiments, the mismatch is at position 1, 2, 3, 4, 5, or 6 from the 5'-end of the 5' wing region or the 3' wing region.

B. GFAP

In certain embodiments, oligomeric compounds comprise or consist of an oligonucleotide that is complementary to a target nucleic acid, wherein the target nucleic acid is a GFAP nucleic acid. In certain embodiments, GFAP nucleic acid has the sequence set forth in SEQ ID NO: 1 (GENBANK Accession No. NM_002055.4), SEQ ID NO: 2 (GENBANK Accession No. NC_000017.11 truncated from nucleotides 44903001 to 44919000), or SEQ ID NO: 3 (GENBANK Accession No. NM_001131019.2).

In certain embodiments, contacting a cell with an oligomeric compound complementary to any of SEQ ID NO: 1-3 reduces the amount of GFAP RNA and in certain embodiments reduces the amount of GFAP protein. In certain embodiments, the oligomeric compound consists of a modified oligonucleotide. In certain embodiments, contacting a cell with an oligomeric compound complementary to any of SEQ ID NO: 1-3 reduces the amount of GFAP RNA in a cell, and in certain embodiments reduces the amount of GFAP protein in a cell. In certain embodiments, the cell is in vitro. In certain embodiments, the cell is in a subject. In certain embodiments, the oligomeric compound consists of a modified oligonucleotide. In certain embodiments, contacting a cell in a subject with an oligomeric compound complementary to any of SEQ ID NO: 1-3 ameliorates one or more symptom or hallmark of a leukodystrophy. In certain embodiments, the leukodystrophy is AxD. In certain embodiments, the symptom or hallmark is selected from motor delays, cognitive delays, paroxysmal deterioration, seizures, vomiting, swallowing difficulties, ataxic gait, palatal myoclonus, autonomic dysfunction, and presence of intra-astrocytic inclusions called Rosenthal fibers.

In certain embodiments, an oligomeric compound complementary to any of SEQ ID NO: 1-3 is capable of reducing the detectable amount of GFAP RNA in vitro by at least 10%, at least 20%, at least 30%, at least 40%, at least 50%, at least 60%, at least 70%, at least 80%, or at least 90% when administered according to the standard cell assay. In certain embodiments, an oligomeric compound complementary to SEQ ID NO: 1, SEQ ID NO: 2915, or SEQ ID NO: 2916 is capable of decreasing the amount of GFAP in vitro by at least 10%, at least 20%, at least 30%, at least 40%, at least 50%, at least 60%, at least 70%, at least 80%, or at least 90% when administered according to the standard in vitro assay. In certain embodiments, an oligomeric compound complementary to SEQ ID NO: 1. SEQ ID NO: 2, or SEQ ID NO: 3 is capable of reducing the detectable amount of GFAP RNA in the CSF of a subject by at least 10%, at least 20%, at least 30%, at least 40%, at least 50%, at least 60%, at least 70%, at least 80%, or at least 90%. In certain embodiments, an oligomeric compound complementary to SEQ ID NO: 1, SEQ ID NO: 2, or SEQ ID NO: 3 is capable of decreasing the detectable amount of GFAP in the CSF of a subject by at least 10%, at least 20%, at least 30%, at least 40%, at least 50%, at least 60%, at least 70%, at least 80%, or at least 90%.

C. Certain Target Nucleic Acids in Certain Tissues

In certain embodiments, oligomeric compounds comprise or consist of an oligonucleotide comprising a portion that is complementary to a target nucleic acid, wherein the target nucleic acid is expressed in a pharmacologically relevant tissue. In certain embodiments, the pharmacologically relevant tissues are the cells and tissues that comprise the central nervous system (CNS). Such tissues include the brain and spinal cord. In certain embodiments, the pharmacologically relevant tissues include white matter tracts across the brain and spinal cord, such tissues include the corpus callosum, cortex, cerebellum, hippocampus, brain stem, striatum, and spinal cord. In certain embodiments, the pharmacologically relevant tissues include the cortex, cerebellum, hippocampus, brain stem, and spinal cord. In certain embodiments, the pharmacologically relevant cells are oligodendrocytes and oligodendrocyte progenitor cells. In certain embodiments, the pharmacologically relevant cells are Schwann cells or Schwann cell progenitors.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid ("artificial CSF" or "aCSF"). In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to a subject, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents comprising an oligomeric compound provided herein to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzil alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™: the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), intraneural, perineural, etc.). In certain of such embodiments, a pharmaceutical composition comprises a carrier and is formulated in aqueous solution, such as water or physiologically compatible buffers such as Hanks's solution. Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form. e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphate linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or salt thereof" expressly includes all such forms that may be fully or partially protonated/de-protonated/in association with a cation. In certain instances, one or more specific cation is identified.

In certain embodiments, modified oligonucleotides or oligomeric compounds are in aqueous solution with sodium. In certain embodiments, modified oligonucleotides or oligomeric compounds are in aqueous solution with potassium. In certain embodiments, modified oligonucleotides or oligomeric compounds are in PBS. In certain embodiments, modified oligonucleotides or oligomeric compounds are in water. In certain such embodiments, the pH of the solution is adjusted with NaOH and/or HCl to achieve a desired pH.

Herein, certain specific doses are described. A dose may be in the form of a dosage unit. For clarity, a dose (or dosage unit) of a modified oligonucleotide or an oligomeric compound in milligrams indicates the mass of the free acid form of the modified oligonucleotide or oligomeric compound. As described above, in aqueous solution, the free acid is in equilibrium with anionic and salt forms. However, for the purpose of calculating dose, it is assumed that the modified oligonucleotide or oligomeric compound exists as a solvent-free, sodium-acetate free, anhydrous, free acid. For example, where a modified oligonucleotide or an oligomeric compound is in solution comprising sodium (e.g., saline), the modified oligonucleotide or oligomeric compound may be partially or fully de-protonated and in association with Na+ ions. However, the mass of the protons are nevertheless counted toward the weight of the dose, and the mass of the Na+ ions are not counted toward the weight of the dose. Thus, for example, a dose, or dosage unit, of 10 mg of Compound No. 1362458, equals the number of fully protonated molecules that weighs 10 mg. This would be equivalent to 10.47 mg of solvent-free, sodium acetate-free, anhydrous sodiated Compound No. 1362458. When an oligomeric compound comprises a conjugate group, the mass of the conjugate group is included in calculating the dose of such oligomeric compound. If the conjugate group also has an acid, the conjugate group is likewise assumed to be fully protonated for the purpose of calculating dose.

VII. Certain Compositions

1. Compound No. 1166998

In certain embodiments, Compound No. 1166998 is characterized as a 6-104 MOE gapmer having a sequence (from 5' to 3') of CAGTATTACCTCTACTAGTC (SEQ ID NO: 2905), wherein each of nucleosides 1-6 and 17-20 (from 5' to 3') are 2'-β-D-MOE nucleosides and each of nucleosides 7-16 are 2'-β-D-deoxynucleosides, wherein the internucleoside linkages between nucleosides 2 to 3, 3 to 4, 4 to 5, 5 to 6, 6 to 7, and 17 to 18 are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methylcytosine.

In certain embodiments, Compound No. 1166998 is represented by the following chemical notation: ${}^{m}C_{es}A_{eo}G_{eo}T_{eo}A_{eo}T_{eo}T_{ds}A_{ds}{}^{m}C_{ds}{}^{m}C_{ds}T_{ds}{}^{m}C_{ds}T_{ds}A_{ds}{}^{m}C_{ds}T_{ds}A_{eo}G_{es}T_{es}{}^{m}C_{e}$ (SEQ ID NO: 2905), wherein:

A=an adenine nucleobase, ${}^{m}C$=a 5-methylcytosine nucleobase,

G=a guanine nucleobase,

T=a thymine nucleobase, e=a 2'-β-D-MOE sugar moiety. d=a 2'-β-D-deoxyribosyl sugar moiety, s=a phosphorothioate internucleoside linkage, and o=a phosphodiester internucleoside linkage.

In certain embodiments, Compound No. 1166998 is represented by the following chemical structure:
(SEQ ID NO: 2905)
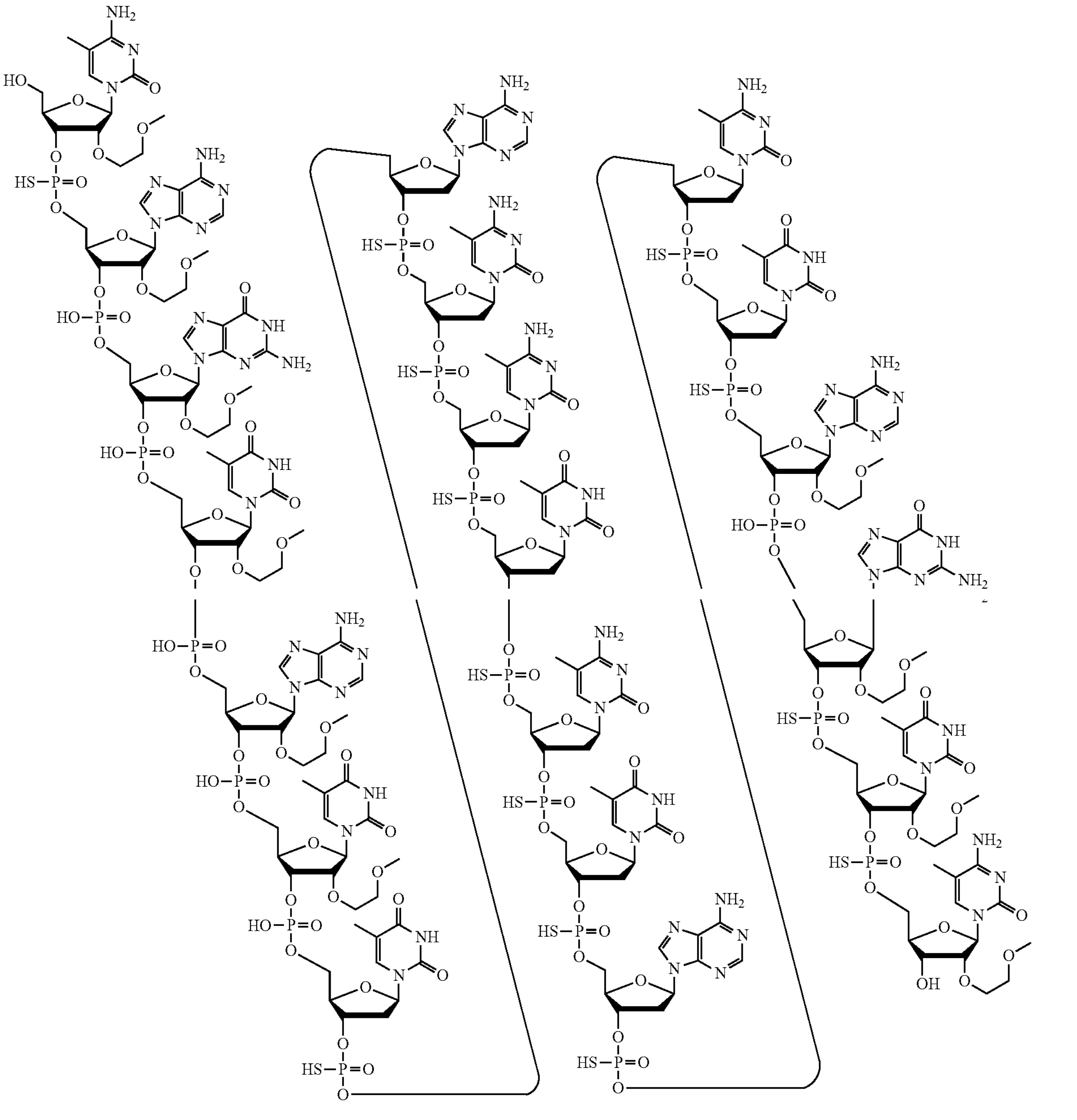

Structure 1. Compound No. 1166998
In certain embodiments, the sodium salt of Compound No. 1100998 is represented by the following chemical structure:
(SEQ ID NO: 2905)
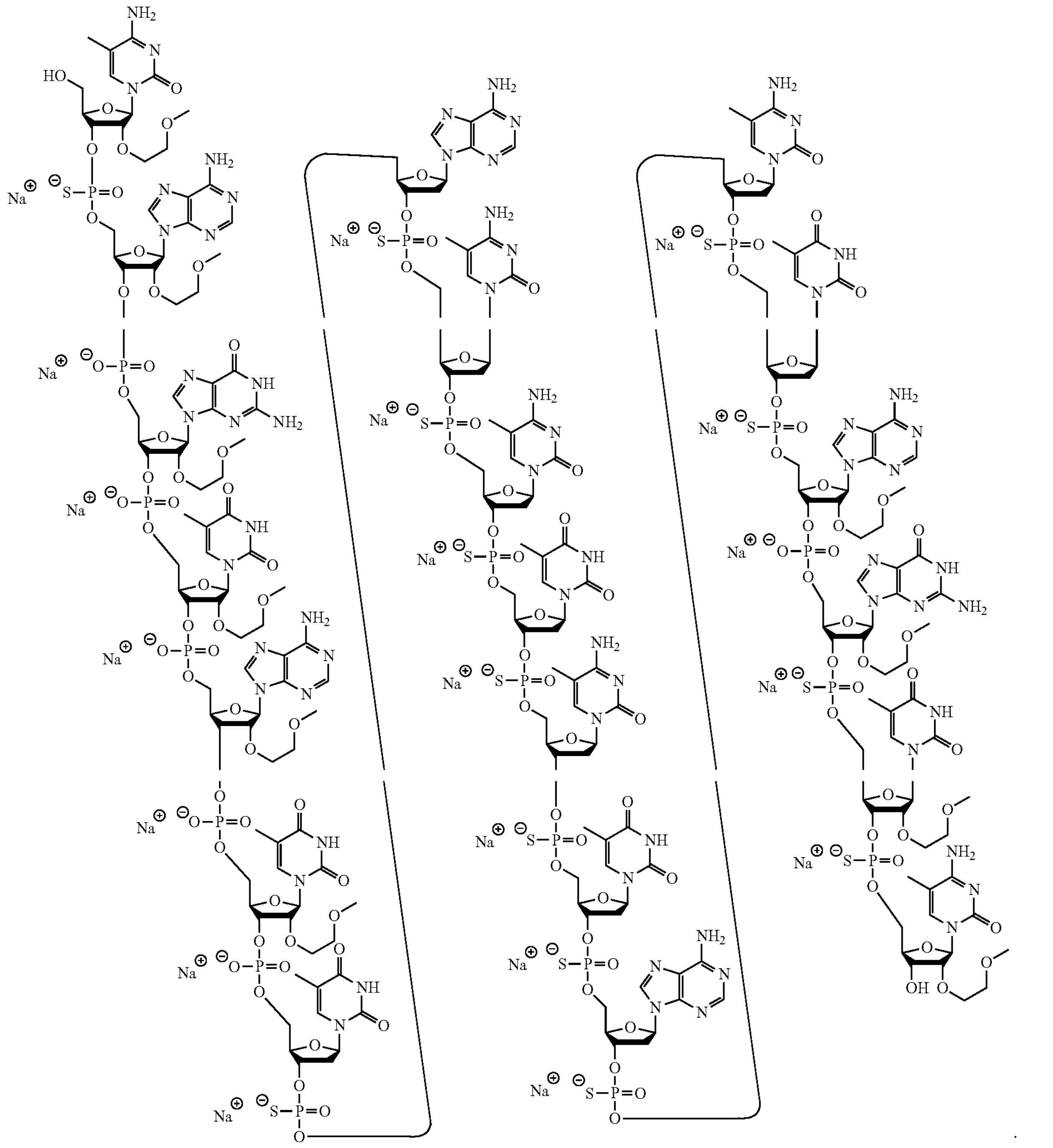

-continued

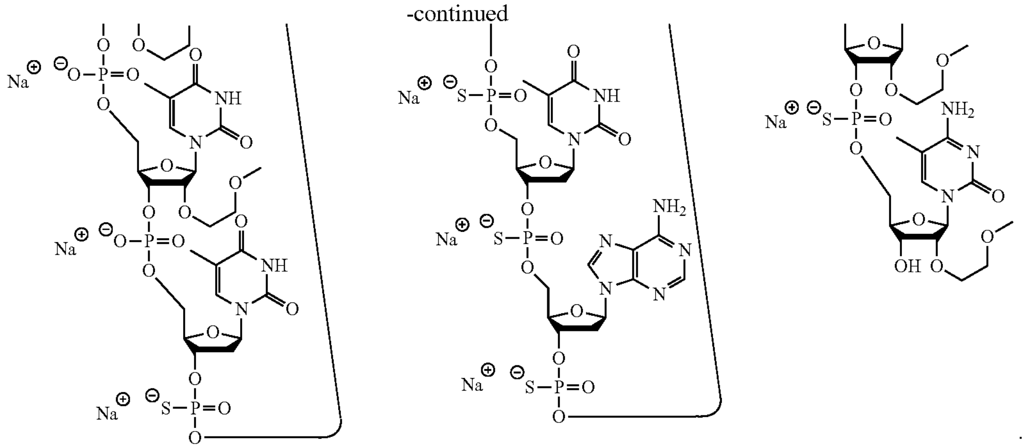

Structure 2. The sodium salt of Compound No. 1166998

2. Compound No. 1166985

In certain embodiments. Compound No. 1166985 is characterized as a 6-104 MOE gapmer having a sequence (from 5' to 3') of CACATTCACTAATATTTAAC (SEQ ID NO: 2904), wherein each of nucleosides 1-6 and 17-20 (from 5' to 3') are 2'-β-D-MOE nucleosides and each of nucleosides 7-16 are 2'-1-D-deoxynucleosides, wherein the internucleoside linkages between nucleosides 2 to 3, 3 to 4, 4 to 5, 5 to 6, 6 to 7, and 17 to 18 are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methylcytosine.

In certain embodiments, Compound No. 1166985 is represented by the following chemical notation: $^{m}C_{es}A_{eo}{}^{m}C_{eo}A_{eo}T_{eo}T_{eo}{}^{m}C_{ds}A_{ds}{}^{m}C_{ds}A_{ds}{}^{m}C_{ds}T_{ds}A_{ds}A_{ds}T_{ds}A_{ds}T_{ds}T_{ds}T_{ds}T_{eo}A_{es}A_{es}{}^{m}C_{e}$ (SEQ ID NO: 2904), wherein:

A=an adenine nucleobase.

$^{m}$C=a 5-methylcytosine nucleobase.

G=a guanine nucleobase,

T=a thymine nucleobase, e=a 2'-β-D-MOE sugar moiety, d=a 2'-β-D-deoxyribosyl sugar moiety, s=a phosphorothioate internucleoside linkage, and o=a phosphodiester internucleoside linkage.

In certain embodiments, Compound No. 1160985 is represented by the following chemical structure:

(SEQ ID NO: 2904)

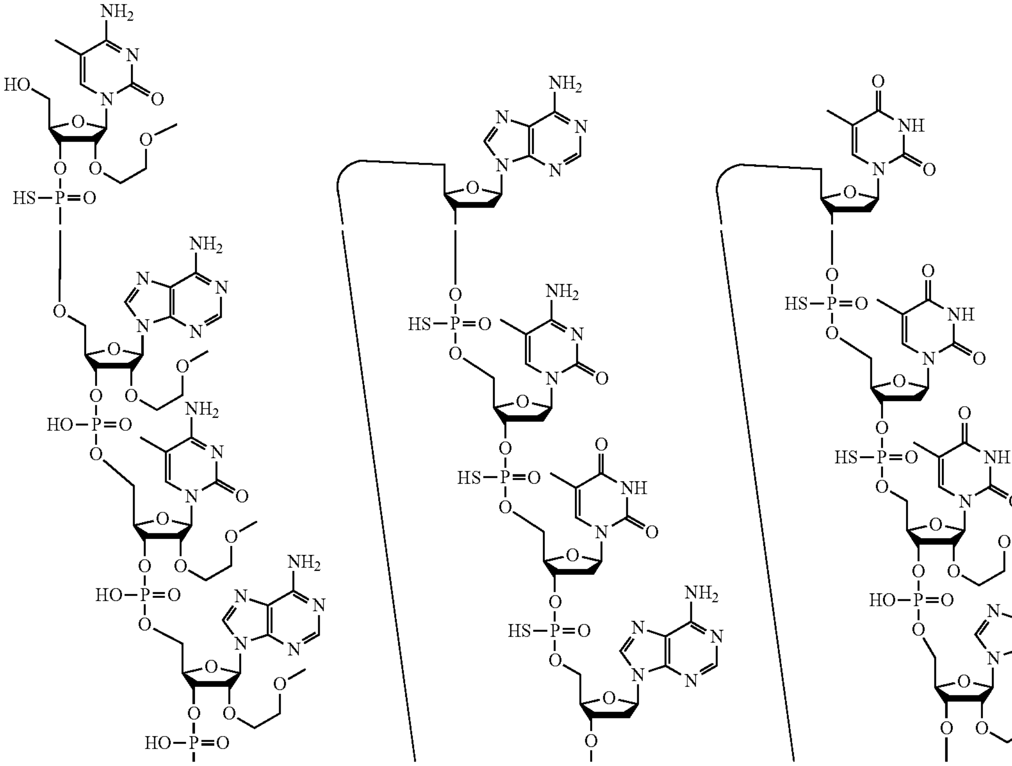

-continued
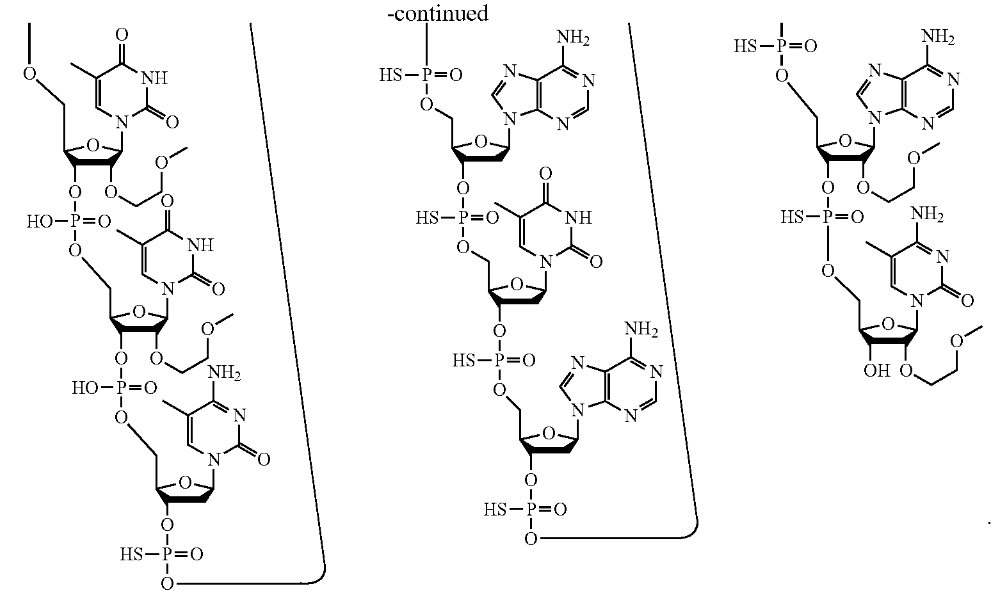
Structure 3. Compound No. 1166985
In certain embodiments, the sodium salt of Compound No. 1160985 is represented by the following chemical structure:
(SEQ ID NO: 2904)
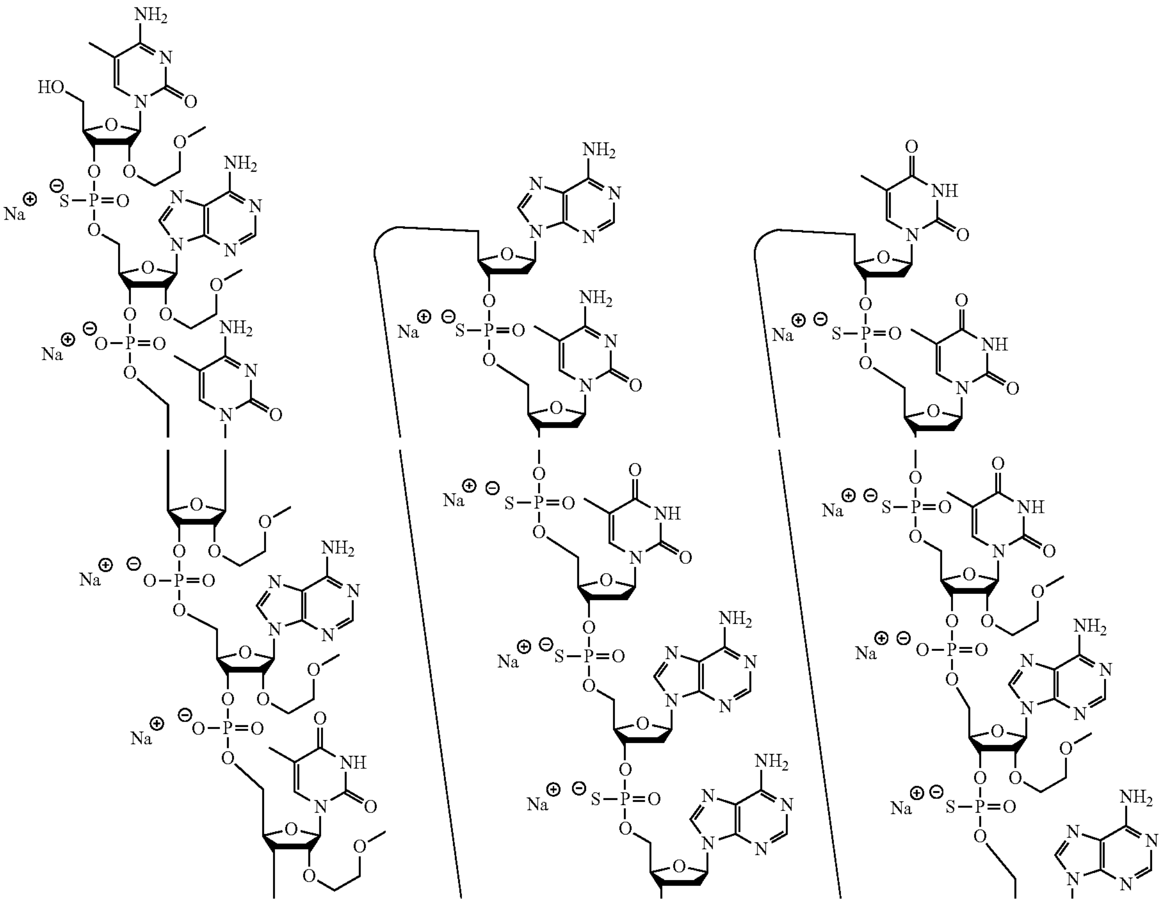

-continued

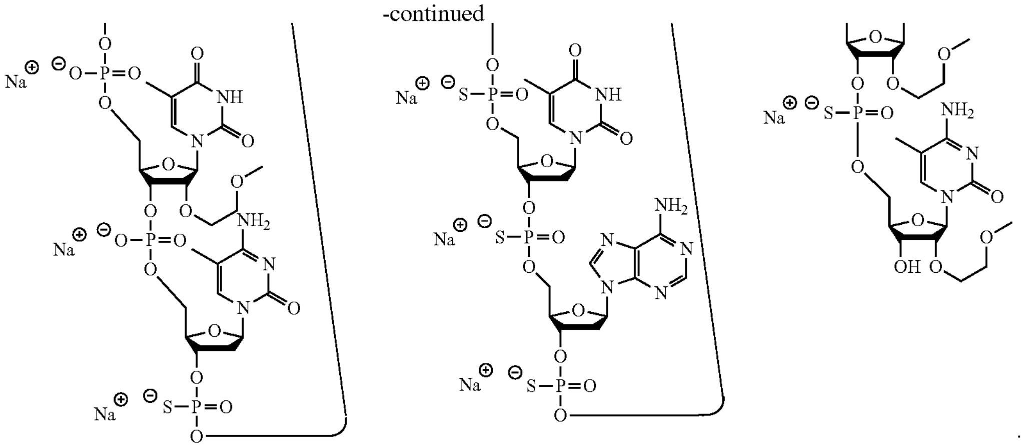

Structure 4. The sodium salt of Compound No. 1166985

3. Compound No. 1166954

In certain embodiments. Compound No. 1166954 is characterized as a 5-10-5 MOE gapmer having a sequence (from 5' to 3') of CCAGTGTCTTCACTTTGCTC (SEQ ID NO: 2903), wherein each of nucleosides 1-5 and 16-20 (from 5' to 3') are 2'-β-D-MOE nucleosides and each of nucleosides 6-15 are 2'-1-D-deoxynucleosides, wherein the internucleoside linkages between nucleosides 2 to 3, 3 to 4, 4 to 5, 5 to 6, 16 to 17, and 17 to 18 are phosphodiester internucleoside linkages and the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methylcytosine.

In certain embodiments, Compound No. 1166954 is represented by the following chemical notation: ${}^{m}C_{es}{}^{m}C_{eo}A_{eo}G_{eo}T_{eo}G_{ds}T_{ds}{}^{m}C_{ds}T_{ds}T_{ds}{}^{m}C_{ds}A_{ds}{}^{m}C_{ds}T_{ds}T_{ds}T_{eo}G_{eo}{}^{m}C_{es}T_{es}{}^{m}C_{e}$ (SEQ ID NO: 2903), wherein:

A=an adenine nucleobase, ${}^{m}C$=a 5-methylcytosine nucleobase,

G=a guanine nucleobase,

T=a thymine nucleobase, e=a 2'-β-D-MOE sugar moiety, d=a 2'-β-D-deoxyribosyl sugar moiety, s=a phosphorothioate internucleoside linkage, and o=a phosphodiester internucleoside linkage.

In certain embodiments, Compound No. 1160954 is represented by the following chemical structure:

(SEQ ID NO: 2903)

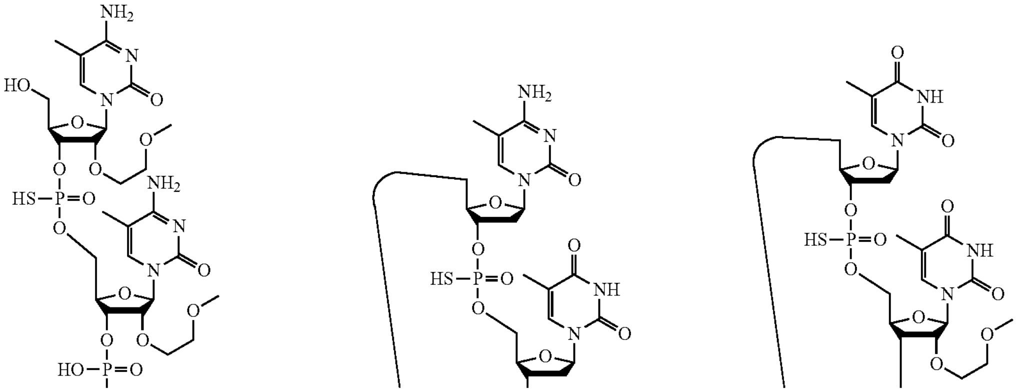

-continued
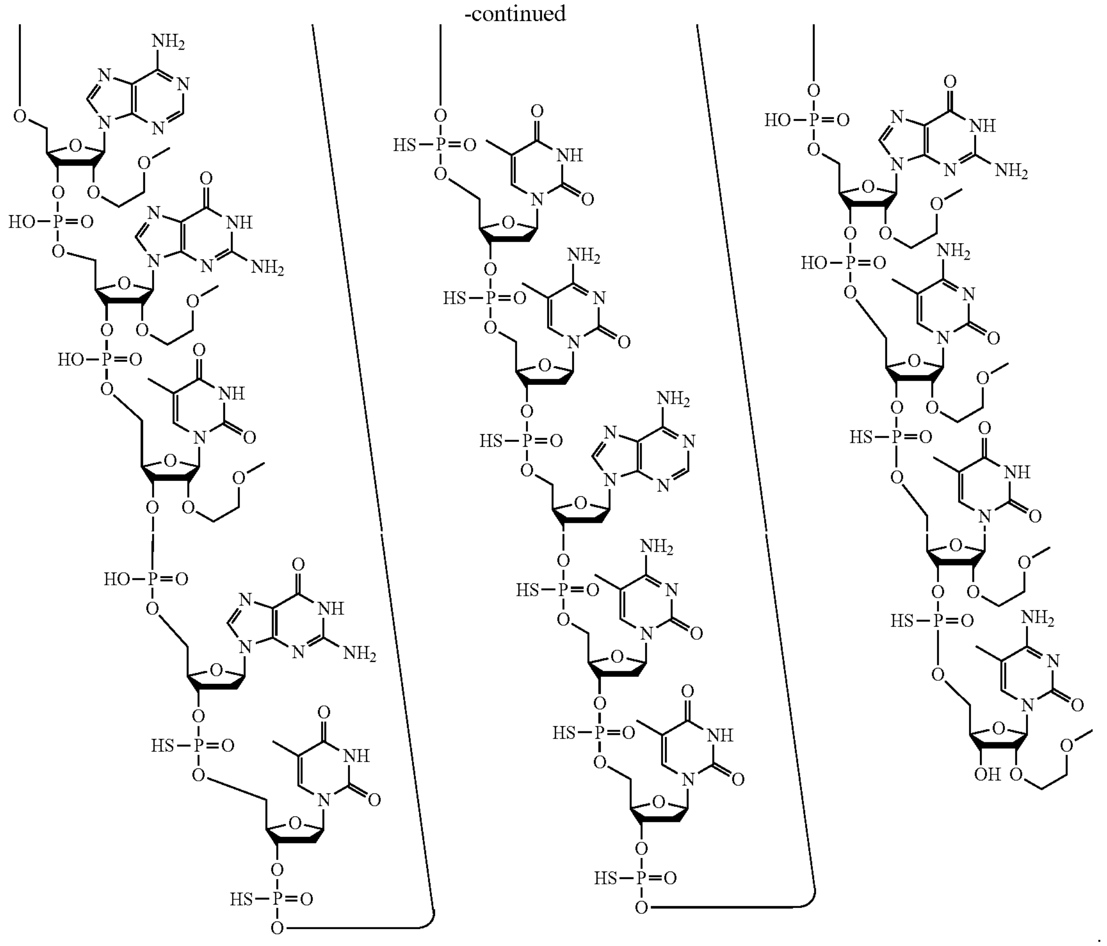
Structure 5: Compound No. 11669154
In certain embodiments, the sodium salt of Compound No. 1160954 is represented by the following chemical structure:
(SEQ ID NO: 2903)
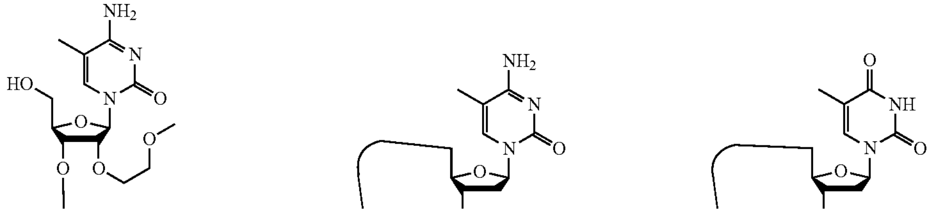

-continued

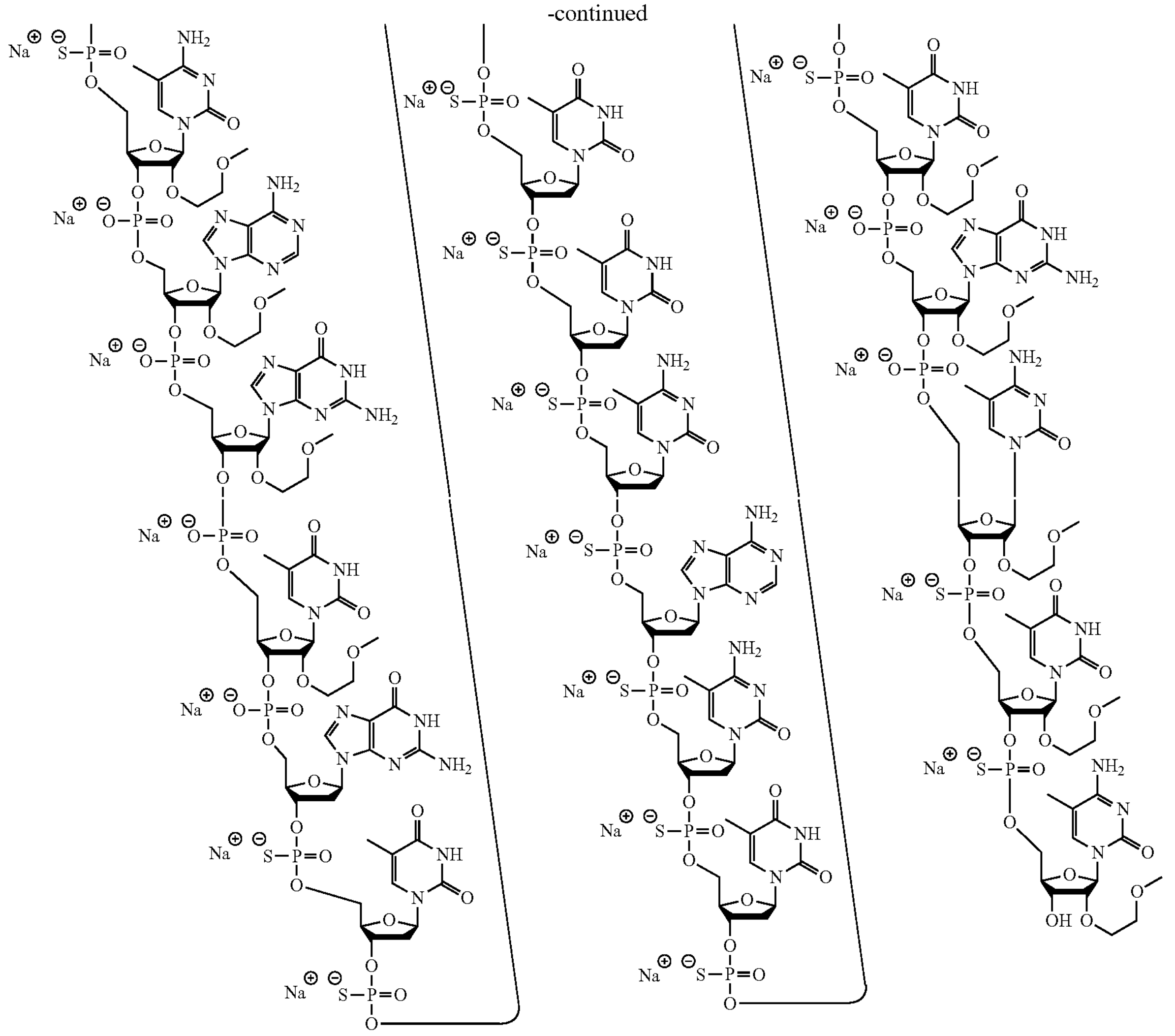

Structure 6: The sodium salt of Compound No. 1166914

4. Compound No. 1072813

In certain embodiments. Compound No. 1072813 is characterized as a 5-10-5 MOE gapmer having a sequence (from 5' to 3') of GCAACAGTTTCCATAACAAC (SEQ ID NO: 2902), wherein each of nucleosides 1-5 and 16-20 (from 5' to 3') are 2'-β-D-MOE nucleosides and each of nucleosides 6-15 are 2'-1-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methylcytosine.

In certain embodiments, Compound No. 1072813 is represented by the following chemical notation: $G_{es}{}^{m}C_{eo}A_{eo}A_{eo}{}^{m}C_{es}A_{ds}G_{ds}T_{ds}T_{ds}T_{ds}{}^{m}C_{ds}{}^{m}C_{ds}A_{ds}T_{ds}A_{ds}A_{eo}{}^{m}C_{eo}A_{es}A_{es}{}^{m}C_{e}$ (SEQ ID NO: 2902), wherein:

A=an adenine nucleobase, $^{m}$C=a 5-methylcytosine nucleobase,

G=a guanine nucleobase,

T=a thymine nucleobase, e=a 2'-β-D-MOE sugar moiety, d=a 2'-β-D-deoxyribosyl sugar moiety, s=a phosphothioate internucleoside linkage, and o=a phosphodiester internucleoside linkage.

In certain embodiments, Compound No. 1072813 is represented by the following chemical structure:

(SEQ ID NO: 2902)
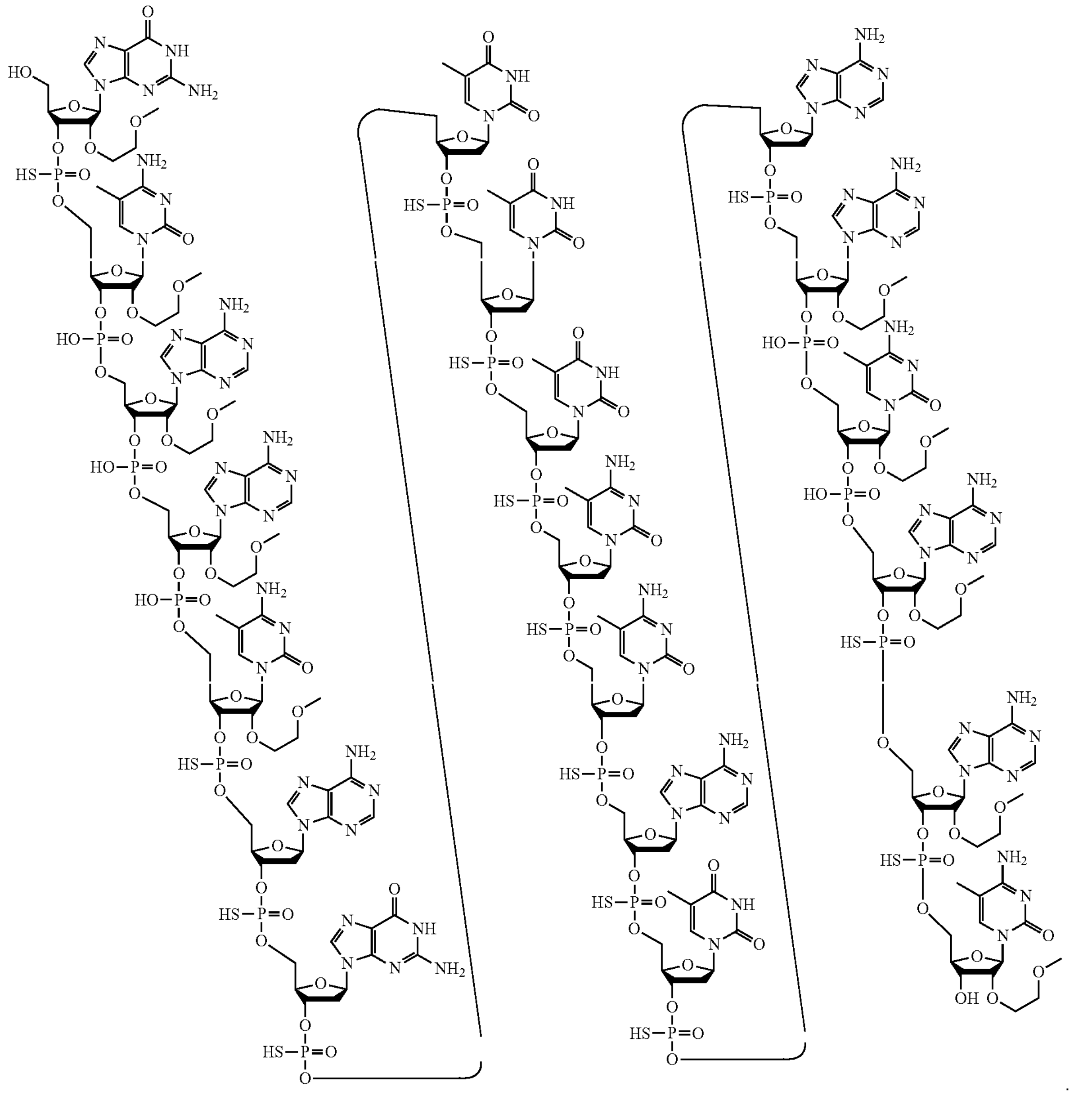
Structure 7: Compound No. 1072813
In certain embodiments, the sodium salt of Compound No. 1072813 is represented by the following chemical structure:

(SEQ ID NO: 2902)

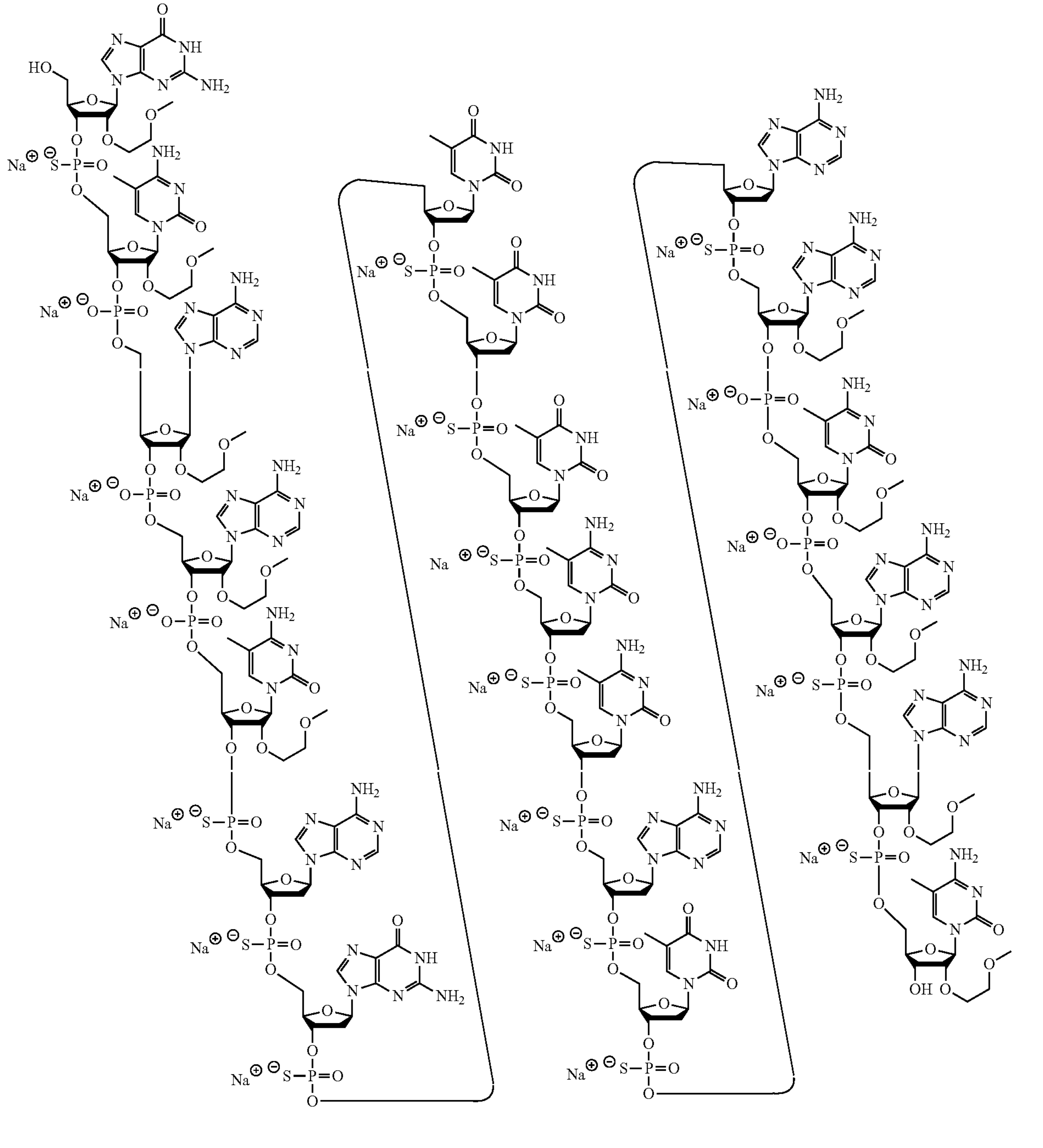

Structure 8: The sodium salt of Compound No. 1072813

5. Compound No. 1199983

In certain embodiments. Compound No. 1199983 is characterized as a 5-10-5 MOE gapmer having a sequence (from 5' to 3') of TGGTCCTAAATATTCTAGTC (SEQ ID NO: 2906), wherein each of nucleosides 1-5 and 16-20 (from 5' to 3') are 2'-β-D-MOE nucleosides and each of nucleosides 6-15 are 2'-1-D-deoxynucleosides, wherein the internucleoside linkages between nucleosides 2 to 3, 3 to 4, 4 to 5, 5 to 6, 16 to 17, and 17 to 18 are phosphodiester internucleoside linkages and the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methylcytosine.

In certain embodiments, Compound No. 1199983 is represented by the following chemical notation: $T_{es}G_{eo}G_{eo}$-$T_{eo}{}^{m}C_{eo}{}^{m}C_{ds}T_{ds}A_{ds}A_{ds}A_{ds}T_{ds}A_{ds}T_{ds}T_{ds}T_{ds}{}^{m}C_{ds}T_{eo}A_{e}$-${}_{o}G_{es}T_{es}{}^{m}C_{e}$ (SEQ ID NO: 2906), wherein:

A=an adenine nucleobase, ${}^{m}C$=a 5-methylcytosine nucleobase,

G=a guanine nucleobase,

T=a thymine nucleobase, e=a 2'-β-D-MOE sugar moiety, d=a 2'-β-D-deoxyribosyl sugar moiety, s=a phosphorothioate internucleoside linkage, and o=a phosphodiester internucleoside linkage.

In certain embodiments, Compound No. 1199983 is represented by the following chemical structure:
(SEQ ID NO: 2906)
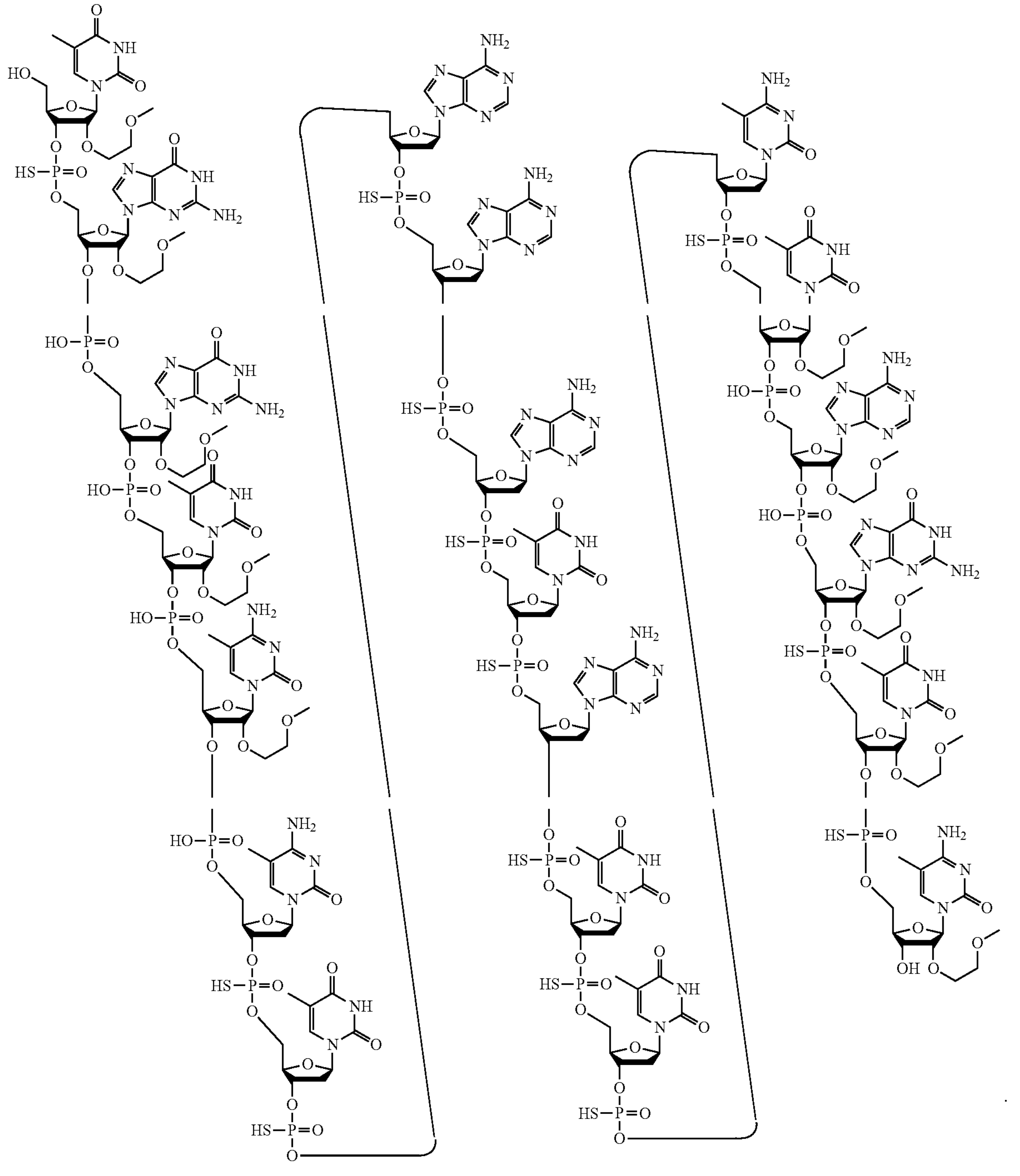

Structure 9: Compound No. 1199983

In certain embodiments, the sodium salt of Compound No. 1199983 is represented by the following chemical structure:

to 15 and 15 to 16 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 16 to 17, and 17 to 18 are (SEQ ID NO: 2906)

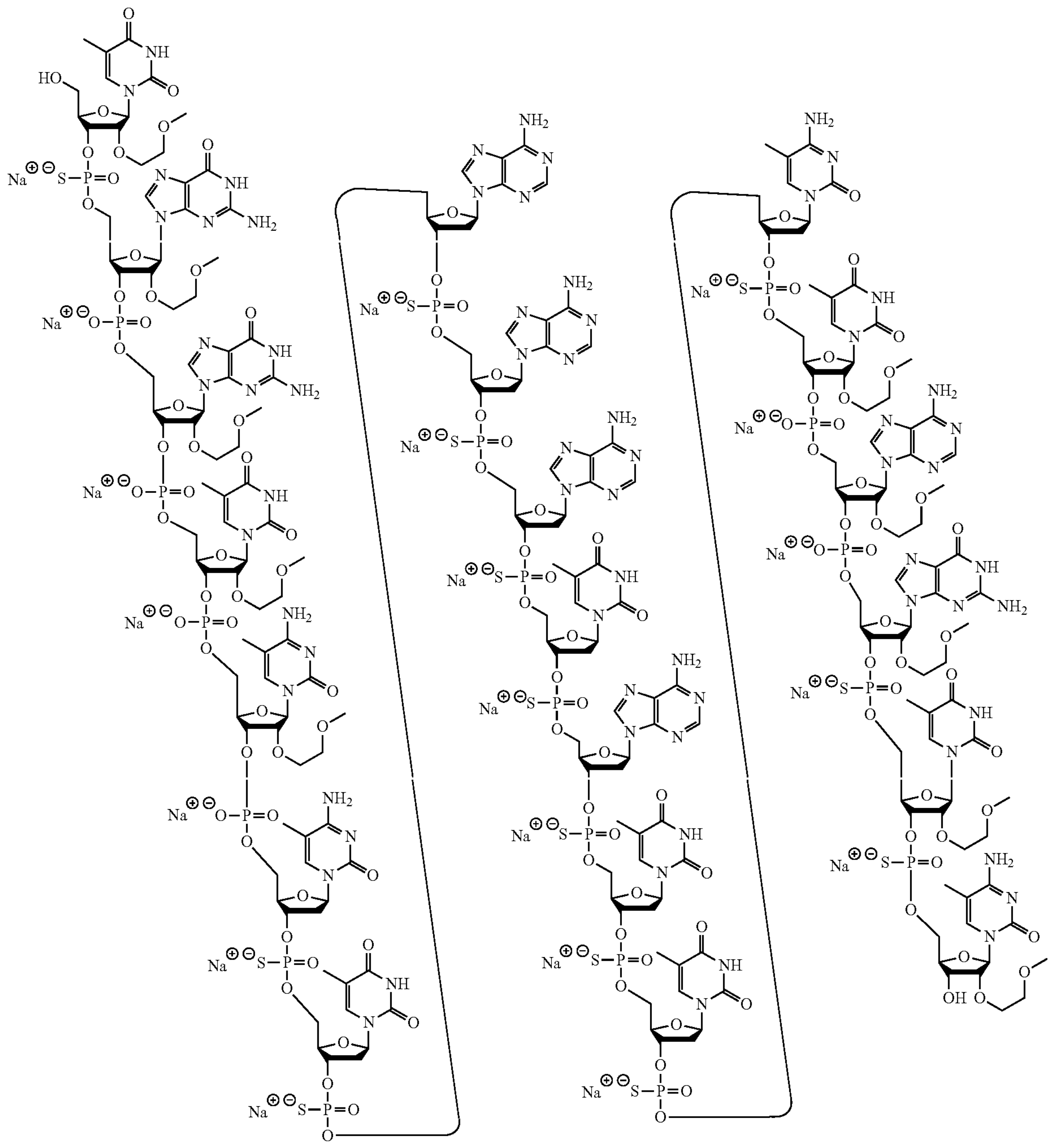

Structure 10: The sodium salt or Compound No. 1199993

6. Compound No. 1166721

In certain embodiments. Compound No. 1166721 is characterized as a 5-8-5 MOE gapmer having a sequence (from 5' to 3') of TGGTCCTAAATATTCTAGTC (SEQ ID NO: 2901), wherein each of nucleosides 1-5 and 14-18 (from 5' to 3') are 2'-β-D-MOE nucleosides and each of nucleosides 6-15 are 2'-1-D-deoxynucleosides, wherein the internucleoside linkages between nucleosides 2 to 3, 3 to 4, 4 to 5, 14 phosphorothioate internucleoside linkages, and wherein each cytosine is a 5-methylcytosine.

In certain embodiments, Compound No. 1166721 is represented by the following chemical notation: $T_{es}G_{eo}G_{eo}{}^{m}C_{eo}A_{ds}G_{ds}T_{ds}A_{ds}T_{ds}T_{ds}A_{ds}{}^{m}C_{ds}{}^{m}C_{ds}T_{eo}{}^{m}C_{eo}T_{es}A_{es}{}^{m}C_{e}$ (SEQ ID NO: 2901), wherein:

A=an adenine nucleobase, ${}^{m}$C=a 5-methylcytosine nucleobase,

G=a guanine nucleobase,
T=a thymine nucleobase,
e=a 2'-β-D-MOE sugar moiety,
d=a 2'-β-D-deoxyribosyl sugar moiety.

s=a phosphorothioate internucleoside linkage, and
o=a phosphodiester internucleoside linkage.

In certain embodiments, Compound No. 1160721 is represented by the following chemical structure:

(SEQ ID NO: 2901)

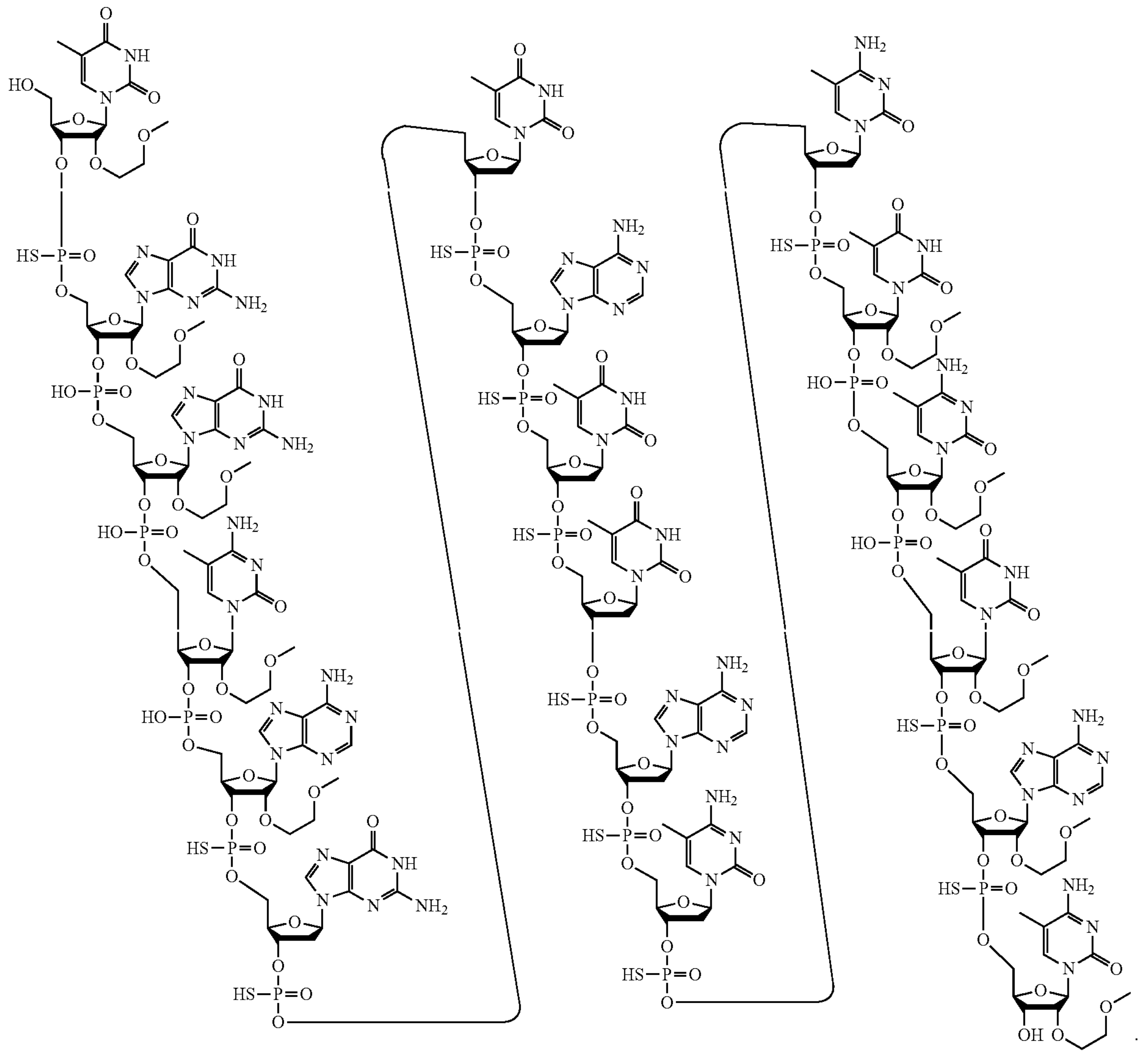

Structure 11: Compound No. 1166721

In certain embodiments, the sodium salt of Compound No. 1166721 is represented by the following chemical structure:

(SEQ ID NO: 2901)

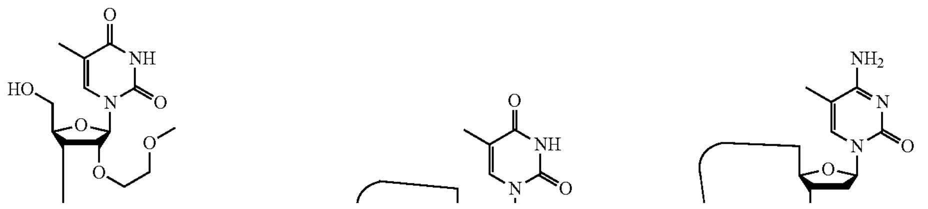

-continued

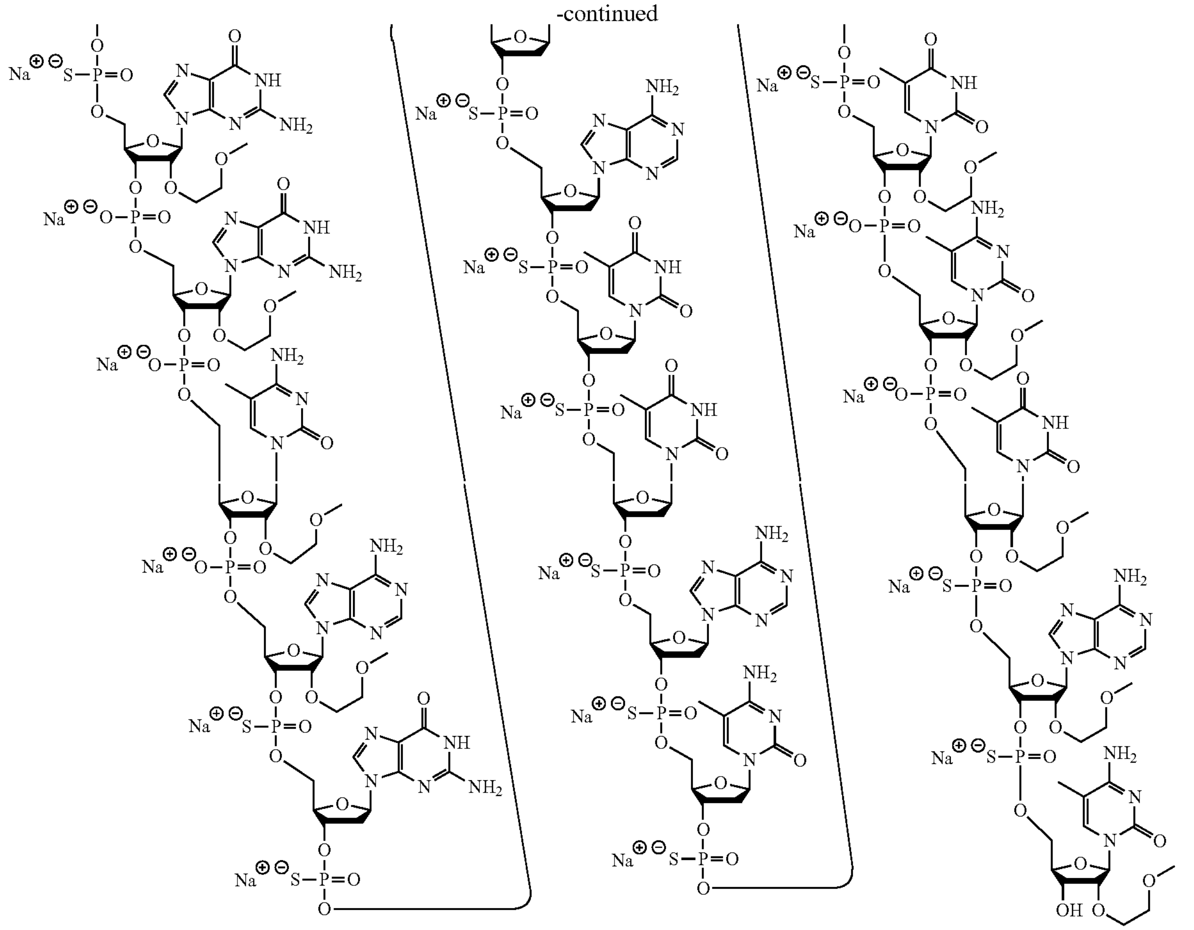

Structure 12: The sodium salt of Compound No. 1166721

VIII. Certain Hotspot Regions

In certain embodiments, nucleobases in the ranges specified below comprise a hotspot region of GFAP nucleic acid. In certain embodiments, modified oligonucleotides that are complementary to a hotspot region of GFAP nucleic acid achieve an average of more than 50% reduction of GFAP RNA in vitro in the standard cell assay. In certain embodiments, modified oligonucleotides that are complementary to a hotspot region of GFAP nucleic acid achieve an average of 75% or greater reduction of GFAP RNA in vivo in the standard in vivo assay.

1. Nucleobases 9324-9348 of SEQ ID NO: 2 In certain embodiments, nucleobases 9324-9348 of SEQ ID NO: 2 comprise a hotspot region. In certain embodiments, modified oligonucleotides are complementary to a portion of nucleobases 9324-9348 of SEQ ID NO: 2. In certain embodiments, modified oligonucleosides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphoothioate internucleoside linkages and phosphodiester internucleoside linkages. In certain embodiments, the phosphodiester ("o") and phosphorthioate ("s") internucleoside linkages are arranged in order from 5' to 3':

In certain embodiments, modified nucleotides have an internucleoside linkage motif of sooosssssssssssooss, soooosssssssssssoss, sooosssssssssssooss, sooossssssssooss, or sooosssssssssssoooss, wherein each "s" represents a phosphorothioate internucleoside linkage and each "o" represents a phosphodiester internucleoside linkage.

The nucleobase sequences of SEQ ID Nos: 21, 1177, 2321, 2398, 2808-2809, 2840-2842, and 2853-2854 are complementary to a portion of nucleobases 9324-9348 of SEQ ID NO: 2.

The nucleobase sequence of Compound Nos.: 1048181-1048182, 1104071-1104072, 1166746-1166748, 1166803-1166808, 1166894-1166899, 1166985-1166990, 1174016, and 1174018 are complementary to a portion of nucleobases 9324-9348 of SEQ ID NO: 2.

In certain embodiments, modified oligonucleotides complementary to a portion of nucleobases 9324-9348 of SEQ ID NO: 2 achieve at least 7% reduction of GFAP RNA in vitro in the standard cell assay. In certain embodiments, modified oligonucleotides complementary to a portion of nucleobases 9324-9348 of SEQ ID NO: 2 achieve an average of 42% reduction of GFAP RNA in vitro in the standard cell assay. In certain embodiments, modified oligonucleotides complementary to a portion of nucleobases 9324-9348 of SEQ ID NO: 2 achieve an average of 81% reduction of GFAP RNA in vivo in the standard in vivo assay.

2. Nucleobases 9459-9480 of SEO ID NO: 2

In certain embodiments, nucleobases 9459-9480 of SEQ ID NO: 2 comprise a hotspot region. In certain embodiments, modified oligonucleotides are complementary to a portion of nucleobases 9459-9480 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss or soooosssssssssssooss, wherein each "s" represents a phosphorothioate internucleoside linkage and each "o" represents a phosphodiester internucleoside linkage.

The nucleobase sequences of SEQ ID Nos: 555, 2093, 2170, and 2813 are complementary to a portion of nucleobases 9459-9480 of SEQ ID NO: 2.

The nucleobase sequence of Compound Nos.: 1048190, 1104116-1104117, and 1199982-1199984 are complementary to a portion of nucleobases 9459-9480 of SEQ ID NO: 2.

In certain embodiments, modified oligonucleotides complementary to a portion of nucleobases 9459-9480 of SEQ ID NO: 2 achieve at least 26% reduction of GFAP RNA in vitro in the standard cell assay. In certain embodiments, modified oligonucleotides complementary to a portion of nucleobases 9459-9480 of SEQ ID NO: 2 achieve an average of 42% reduction of GFAP RNA in vitro in the standard cell assay. In certain embodiments, modified oligonucleotides complementary to a portion of nucleobases 9459-9480 of SEQ ID NO: 2 achieve an average of 91% reduction of GFAP RNA in vivo in the standard in vivo assay.

3. Nucleobases 9530-9580 of SEO ID NO: 2

In certain embodiments, nucleobases 9530-9580 of SEQ ID NO: 2 comprise a hotspot region. In certain embodiments, modified oligonucleotides are complementary to a portion of nucleobases 9530-9580 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, soooooosssssssssssoss, soooosssssssssssooss, sooossssssssssooss, or sooosssssssssssoooss, wherein each "s" represents a phosphorothioate internucleoside linkage and each "o" represents a phosphodiester internucleoside linkage.

The nucleobase sequences of SEQ ID Nos.: 20, 88, 166, 1331, 1408, 1485, 1637, 1713, 1714, 1789, 1790, 1637, 1638, 1865, 1866, 1941, 2018, 2095, 2172, 2249, 2326, 2403, 2480, 2557, 2633, 2709, 2785, 2816-2818, 2859, 2861, and 2886-2887 are complementary to a portion of nucleobases 9530-9580 of SEQ ID NO: 2.

The nucleobase sequence of Compound Nos.: 1048200-1048201, 1073062-1073064, 1104142-1104161, 1166719-1166721, 1166816-1166823, 1166826, 1166907-1166920, 1166998-1167011, 1174024, 1174026, and 1174029-1174030 are complementary to a portion of nucleobases 9530-9580 of SEQ ID NO: 2.

In certain embodiments, modified oligonucleotides complementary to a portion of nucleobases 9530-9580 of SEQ ID NO: 2 achieve at least 27% reduction of GFAP RNA in vitro in the standard cell assay. In certain embodiments, modified oligonucleotides complementary to a portion of nucleobases 9530-9580 of SEQ ID NO: 2 achieve an average of 52% reduction of GFAP RNA in vitro in the standard cell assay. In certain embodiments, modified oligonucleotides complementary to a portion of nucleobases 9530-9580 of SEQ ID NO: 2 achieve an average of 82% reduction of GFAP RNA in vivo in the standard in vivo assay.

4. Nucleobases 12006-12038 of SEO ID NO: 2

In certain embodiments, nucleobases 12006-12038 of SEQ ID NO: 2 comprise a hotspot region. In certain embodiments, modified oligonucleotides are complementary to a portion of nucleobases 12006-12038 of SEQ ID NO: 2.

In certain embodiments, modified oligonucleotides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, wherein each "s" represents a phosphoothioate internucleoside linkage and each "o" represents a phosphodiester internucleoside linkage.

The nucleobase sequences of SEQ ID Nos.: 815, 893, 971, 1049, 1269, 1270, 1346, 1423, 1499, 1500, 1660, 1736, 2655, and 2731 are complementary to a portion of nucleobases 12006-12038 of SEQ ID NO: 2.

The nucleobase sequence of Compound Nos.: 1047362-1047365, 1072813-1072818, and 1103276-1103279 are complementary to a portion of nucleobases 12006-12038 of SEQ ID NO: 2.

In certain embodiments, modified oligonucleotides complementary to a portion of nucleobases 12006-12038 of SEQ ID NO: 2 achieve at least 29% reduction of GFAP RNA in vitro in the standard cell assay. In certain embodiments, modified oligonucleotides complementary to a portion of nucleobases 12006-12038 of SEQ ID NO: 2 achieve an average of 52% reduction of GFAP RNA in vitro in the standard cell assay. In certain embodiments, modified oligonucleotides complementary to a portion of nucleobases 12006-12038 of SEQ ID NO: 2 achieve an average of 82% reduction of GFAP RNA in vivo in the standard in vivo assay.

5. Nucleobases 13038-13058 of SEO ID NO: 2

In certain embodiments, nucleobases 13038-13058 of SEQ ID NO: 2 comprise a hotspot region. In certain embodiments, modified oligonucleotides are complementary to a portion of nucleobases 13038-13058 of SEQ ID NO: 2. In certain embodiments, modified oligonucleotides are 20 nucleobases in length. In certain embodiments, modified oligonucleotides are 18 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages.

In certain embodiments, the phosphodiester ("o") and phosphorothioate ("s") internucleoside linkages are arranged in order from 5' to 3': In certain embodiments, modified nucleotides have an internucleoside linkage motif of sooossssssssssooss, soooooossssssssssoss, or soooosssssssssssooss, wherein each "s" represents a phosphorothioate internucleoside linkage and each "o" represents a phosphodiester internucleoside linkage.

The nucleobase sequences of SEQ ID Nos.: 825 and 1973 are complementary to a portion of nucleobases 13038-13058 of SEQ ID NO: 2.

The nucleobase sequence of Compound Nos.: 1047522, 1166954, and 1167046 are complementary to a portion of nucleobases 13038-13058 of SEQ ID NO: 2.

In certain embodiments, modified oligonucleotides complementary to a portion of nucleobases 13038-13058 of SEQ ID NO: 2 achieve at least 27% reduction of GFAP RNA in vitro in the standard cell assay. In certain embodiments, modified oligonucleotides complementary to a portion of nucleobases 13038-13058 of SEQ ID NO: 2 achieve an average of 41% reduction of GFAP RNA in vitro in the standard cell assay. In certain embodiments, modified oligonucleotides complementary to a portion of nucleobases 13038-13058 of SEQ ID NO: 2 achieve an average of 84% reduction of GFAP RNA in vivo in the standard in vivo assay.

6. Additional Hotspot Regions

In certain embodiments, the ranges described in the Table below comprise hotspot regions. Each hotspot region begins with the nucleobase of SEQ ID NO: 2 identified in the "Start Site SEQ ID NO: 2" column and ends with the nucleobase of SEQ ID NO: 2 identified in the "Stop Site SEQ ID NO: 2" column. In certain embodiments, modified oligonucleotides are complementary within any of the hotspot regions 1-14, as defined in the table below. In certain embodiments, modified oligonucleotides are 18 nucleobases in length. In certain embodiments, modified oligonucleotides are 20 nucleobases in length. In certain embodiments, modified oligonucleotides are gapmers. In certain embodiments, modified oligonucleotides are 5-8-5, 5-10-3, 4-10-6, 6-104, or 5-10-5 MOE gapmers.

The nucleobase sequence of compounds listed in the "Compound No, in range" column in the table below are complementary to SEQ ID NO: 2 within the specified hotspot region. The nucleobase sequence of the oligonucleotides listed in the "SEQ ID NO: in range" column in the table below are complementary to the target sequence. SEQ ID NO: 2, within the specified hotspot region.

In certain embodiments, modified oligonucleotides complementary to nucleobases within the hotspot region achieve at least "Min. % Red, in vitro" (minimum % reduction, relative to untreated control cells) of GFAP RNA in vitro in the standard cell assay, as indicated in the table below. In certain embodiments, modified oligonucleotides complementary to nucleobases within the hotspot region achieve an average of "Avg. % Red, in vitro" (average % reduction, relative to untreated control cells) of GFAP RNA in vitro in the standard cell assay, as indicated in the table below. In certain embodiments, modified oligonucleotides complementary to nucleobases within the hotspot region achieve a maximum of "Max. % Red, in vitro" (maximum % reduction, relative to untreated control cells) of GFAP RNA in vitro in the standard cell assay, as indicated in the table below. In certain embodiments, modified oligonucleotides complementary to nucleobases within the hotspot region achieve an average of "Avg. % Red, in vivo" (average % reduction, relative to PBS-treated animals) of GFAP RNA in vivo in the standard in vivo assay, as indicated in the table below.

TABLE 1

GFAP Hotspots

| Hotspot ID | Start Site SEQ ID NO: 2 | Start Site SEQ ID NO: 2 | Min. % Red. in vitro | Max. % Red. In vitro | Avg. % Red. in vitro | Avg. % Red. in vivo | Compound No. in Range | SEQ ID NOs: in Range |
|---|---|---|---|---|---|---|---|---|
| 1 | 9324 | 9348 | 7 | 78 | 42 | 81 | 1048181-1048182, 1104071-1104072, 1166746-1166748, 1166803-1166808, 1166894-1166899, 1166985-1166990, 1174016, 1174018 | 21, 1177, 2321, 2398, 2808-2809, 2840-2842, 2853-2854 |
| 2 | 9459 | 9480 | 26 | 65 | 42 | 91 | 1048190, 1104116-1104117, 1199982-1199984 | 555, 2093, 2170, 2813 |
| 3 | 9530 | 9580 | 18 | 82 | 52 | 82 | 1048199-1048201, 1073062-1073064, 1104142-1104161, 1166719-1166721, 1166816-1166823, 1166826, 1166907-1166920, 1166998-1167011, 1174024, 1174026, 1174029-1174030 | 20, 88, 166, 1331, 1408, 1485, 1637, 1713, 1714, 1789, 1790, 1637, 1638, 1865, 1866, 1941, 2018, 2095, 2172, 2249, 2326, 2403, 2480, 2557, 2633, 2709, 2785, 2816-2818, 2859, 2861, 2886-2887 |
| 4 | 12006 | 12038 | 29 | 75 | 52 | 82 | 1047362-1047365, 1072813-1072818, 1103276-1103279 | 815, 893, 971, 1049 1269, 1270, 1346, 1423, 1499, 1500, 1660, 1736, 2655, 2731 |
| 5 | 13038 | 13058 | 27 | 56 | 41 | 84 | 1047522, 1166954, 1167046 | 825, 1973 |
| 6 | 8530 | 8557 | 14 | 79 | 52 | 89 | 1047706-1047708, 1103567-1103571 | 213, 291, 369, 1601, 1753, 1829, 1905, 1982 |

TABLE 1-continued

| GFAP Hotspots | | | | | | | | |
|---|---|---|---|---|---|---|---|---|
| Hotspot ID | Start Site SEQ ID NO: 2 | Start Site SEQ ID NO: 2 | Min. % Red. in vitro | Max. % Red. In vitro | Avg. % Red. in vitro | Avg. % Red. in vivo | Compound No. in Range | SEQ ID NOs: in Range |
| 7 | 8731 | 8754 | 44 | 64 | 53 | 88 | 1047733-1047735, 1103591, 1103592, 1174050, 1174051, 1174056, 1174058, 1174062, 1174063 | 1072, 1149, 1227, 2291, 2368 |
| 8 | 8749 | 8807 | 25 | 92 | 52 | 75 | 1047601-1047610, 1072854-1072868, 1103462-1103472, 1166738-1166740, 1166742, 1166744, 1166793-1166795, 1166798-1166800, 1166885-1166890, 1166975, 1166982, 1174012-1174013 | 51, 129, 207, 752, 830, 908, 986, 1064, 1141, 1219, 1279, 1280-1282, 1356-1359, 1433-1436, 1510-1512, 1595, 1671, 1747, 2206, 2283, 2360, 2437, 2514, 2590, 2666, 2742, 2835-2837, 2839, 2850-2851, 2866 |
| 9 | 9511 | 9536 | 32 | 90 | 55 | 86 | 1048197, 1073060, 1104129-1104133, 1166749-1166751, 1166809-1166810, 1166812-1166813, 1166900-1166903, 1166991-1166994, 1174020 | 1100, 1484, 1864, 1940, 2017, 2094, 2171, 2819-2821, 2856 |
| 10 | 9565 | 9602 | 20 | 75 | 53 | 82 | 1048202-1048204, 1073065, 1104165-1104179, 1166757-1166760, 1166831, 1166835, 1166926-1166929, 1167012, 1167017, 1167018, 1174031, 1174034 | 244, 322, 400, 1562, 1639, 1715, 1791, 1867, 1943, 2020, 2173, 2250, 2327, 2404, 2481, 2558, 2634, 2710, 2786, 2873-2876, 2888, 2891 |
| 11 | 11155 | 11184 | 37 | 82 | 69 | 85 | 1073093-1073095, 1104307-1104312, 1167024-1167027, 1166761-1166763, 1166842-1166843, 1166845-1166847, 1166933-1166934, 1167024-1167027, 1174037 | 1339, 1569, 2028, 2105, 2182, 2259, 2336, 2413, 2822-2824, 2863 |
| 12 | 12044 | 12067 | 49 | 67 | 58 | 85 | 1047372-1047374, 1072824-1072825, 1166852, 1167033-1167036 | 348, 426, 504, 1425, 1502 |
| 13 | 12080 | 12108 | 45 | 88 | 68 | 79 | 1047384-1047388, 1072834-1072835, 1103284-1103285, 1166948, 1167040 | 37, 115, 193, 271, 349, 1274, 1351, 2041, 2118 |
| 14 | 13333 | 13367 | 53 | 93 | 75 | 89 | 1047579-104592, 1072849-1072850, 1166775-1166787, 1166867, 1166869-1166875, 1166877-1166878, 1167050-1167051, 1167053-1167060 | 50, 283, 361, 439, 517, 595, 673, 751, 829, 907, 985, 1063, 1140, 1218, 1278, 1508, 2825-2833, 2843-2846 |

NONLIMITING DISCLOSURE AND INCORPORATION BY REFERENCE

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar moiety (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases.

By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^{m}$CGAUCG," wherein $^{m}$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as a or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, all cis- and trans-isomers and tautomeric forms of the compounds herein are also included unless otherwise indicated. Oligomeric compounds described herein include chirally pure or enriched mixtures as well as racemic mixtures. For example, oligomeric compounds having a plurality of phosphorothioate internucleoside linkages include such compounds in which chirality of the phosphorothioate internucleoside linkages is controlled or is random. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^{1}$H hydrogen atoms. Isotopic substitutions encompassed by the compounds herein include but are not limited to: $^{2}$H or $^{3}$H in place of $^{1}$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments.

Example 1: Effect of 5-10-5 MOE Gapmer Modified Oligonucleotides on Human GFAP RNA In Vitro, Single Dose Modified oligonucleotides complementary to human GFAP nucleic acid were designed and tested for their single dose effects on GFAP RNA in vitro. The modified oligonucleotides were tested in a series of experiments that had similar culture conditions.

The modified oligonucleotides in the tables below are 5-10-5 MOE gapmers with mixed PO/PS internucleoside linkages. The gapmers are 20 nucleosides in length, wherein the central gap segment consists of ten 2'-β-D-deoxynucleosides and the 5' and 3' wing segments each consists of five 2'-MOE modified nucleosides. The sugarmotif for the gapmers is (from 5' to 3'): eeeeedddddddddeecee; wherein 'd' represents a 2'-β-D-deoxyribosyl sugar moiety, and 'e' represents a 2'-MOE sugar moiety. The internucleoside linkage motif for the gapmers is (from 5' to 3'): sooosssssssssssooss; wherein each 'o' represents a phosphodiester internucleoside linkage and each 's' represents a phosphorothioate internucleoside linkage. Each cytosine residue is a 5-methylcytosine.

"Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the Tables below is 100% complementary to SEQ ID NO: 1 (GENBANK Accession No. NM_002055.4), or SEQ ID NO: 2 (GENBANK Accession No. NC_000017.11 truncated from nucleotides 44903001 to 44919000). 'N/A' indicates that the modified oligonucleotide is not 100% complementary to that particular target nucleic acid sequence.

Cultured U251 cells were treated with modified oligonucleotide at a concentration of 4,000 nM using free uptake at a density of 10.000 cells per well. After a treatment period of approximately 48 hours, total RNA was isolated from the cells and GFAP RNA levels were measured by quantitative real-time RTPCR. GFAP RNA levels were measured by human GFAP primer probe set RTS37485 (forward sequence CTGGAGGTTGAGAGGGACA, designated herein as SEQ ID NO: 11; reverse sequence GCTTCATCTGCTTCCTGTCT, designated herein as SEQ ID NO: 12; probe sequence CTGGAGCTTCTGCCTCACAGTGG, designated herein as SEQ ID NO: 13). GFAP RNA levels were normalized to total RNA content, as measured by RIBOGREEN®. Reduction of GFAP RNA is presented in the tables below as percent GFAP RNA amount relative to untreated control cells. Each table represents results from an individual assay plate. The values marked with an asterisk (*) indicate that the modified oligonucleotide is complementary to the amplicon region of the primer probe set. Additional assays may be used to measure the potency and efficacy of the modified oligonucleotides complementary to the amplicon region.

TABLE 2

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047144 | 17 | 36 | 3465 | 3484 | CGAGGGCTTTATGAAGGAGT | 80 | 22 |
| 1047160 | 131 | 150 | 3579 | 3598 | GCCAGGAGCCAGGCCCCCCA | 67 | 23 |
| 1047176 | 248 | 267 | 3696 | 3715 | GGCCCGGGTCTCCTTGAAGC | 109 | 24 |
| 1047192 | 488 | 507 | 3936 | 3955 | GTCCTGTGCCAGATTGTCCC | 7* | 25 |
| 1047208 | 579 | 598 | N/A | N/A | CATCTGCTTCCTGTCTATAG | 6* | 26 |
| 1047224 | 649 | 668 | 5238 | 5257 | CTCAAGAACCGGATCTCCTC | 105 | 27 |
| 1047240 | 813 | 832 | 5699 | 5718 | ACTCTTCGGCTTCATGCATG | 69 | 28 |
| 1047256 | 1029 | 1048 | 7601 | 7620 | GCGCCTCCTGATAACTGGCC | 80 | 29 |
| 1047272 | 1251 | 1270 | 10865 | 10884 | CTTCTGACACAGACTTGGTG | 92 | 30 |
| 1047288 | 1298 | 1317 | 10912 | 10931 | ATCCCGCATCTCCACGGTCT | 90 | 31 |
| 1047304 | 1351 | 1370 | 11640 | 11659 | CTGCCTCACATCACATCCTT | 87 | 32 |
| 1047320 | 1416 | 1435 | 11705 | 11724 | CGGAGCAACTATCCTGCTTC | 102 | 33 |
| 1047336 | 1617 | 1636 | 11906 | 11925 | AAGCTGCTGGCCATGCCCCT | 87 | 34 |
| 1047352 | 1664 | 1683 | 11953 | 11972 | TGCCCCCCGCCCTCCTCCCC | 83 | 35 |
| 1047368 | 1736 | 1755 | 12025 | 12044 | GAGAGAACCTCCATCTCTGG | 47 | 36 |
| 1047384 | 1791 | 1810 | 12080 | 12099 | TCAGTTTTCCTCCAGCAGCC | 55 | 37 |
| 1047400 | 1854 | 1873 | 12143 | 12162 | GACAAAACAAGCCTCTGGCC | 66 | 38 |
| 1047416 | 2036 | 2055 | 12325 | 12344 | CGTCCCCACCCATCTTAGAC | 60 | 39 |
| 1047432 | 2180 | 2199 | 12469 | 12488 | GTGCTGAGAATCAAGCTCCC | 93 | 40 |
| 1047448 | 2237 | 2256 | 12526 | 12545 | CCCCCTCTATCCCTCCCAGC | 11 | 41 |
| 1047464 | 2280 | 2299 | 12569 | 12588 | CTGGGCTTGACCTCTCTGTA | 63 | 42 |
| 1047480 | 2379 | 2398 | 12668 | 12687 | TGGTCACCCACAACCCCTAC | 81 | 43 |
| 1047496 | 2457 | 2476 | 12746 | 12765 | CCCTTTCTCTCCTGTTTCAG | 79 | 44 |
| 1047512 | 2486 | 2505 | 12775 | 12794 | AAGTCATGCCCTGCCCCCAT | 45 | 45 |
| 1047528 | 2780 | 2799 | 13069 | 13088 | GCACCCGGCCTCCAGGCTGC | 76 | 46 |
| 1047544 | 2861 | 2880 | 13150 | 13169 | GGCACAGATCCCACCAGTCT | 106 | 47 |
| 1047560 | 2903 | 2922 | 13192 | 13211 | GAGAGGAGAACCCTGAAGTG | 72 | 48 |
| 1047576 | 3035 | 3054 | 13324 | 13343 | CCTCAGCGACTAAAGGCAGC | 77 | 49 |
| 1047592 | 3058 | 3077 | 13347 | 13366 | GCGCAGCATTTGTCTTTATT | 47 | 50 |
| 1047608 | N/A | N/A | 8777 | 8796 | GCTTTTGAGATATCTTGTGA | 8 | 51 |
| 1047624 | N/A | N/A | 9031 | 9050 | GTTTAATGTACAGTTACTCT | 71 | 52 |
| 1047640 | N/A | N/A | 9070 | 9089 | CCAAGGACTCACCACCTTTA | 75 | 53 |
| 1047656 | N/A | N/A | 9202 | 9221 | AGGGATGAAAGAATAAAGCA | 92 | 54 |
| 1047672 | N/A | N/A | 8381 | 8400 | CCTGCTGTACTGACCTCGAA | 94 | 55 |
| 1047688 | N/A | N/A | 8456 | 8475 | ATCCTCAGTCCCAGTCTGGA | 54 | 56 |
| 1047704 | N/A | N/A | 8504 | 8523 | CTGCAGTGTCACGAAGGCCC | 74 | 57 |

TABLE 2-continued

| Reduction of GFAP RNA by 5-10-5 MOE gapmers with mixed PO/PS internucleoside linkages in U251 cells | | | | | | | |
|---|---|---|---|---|---|---|---|
| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
| 1047720 | N/A | N/A | 8637 | 8656 | TGTCAAGCTCTCACCCAGTT | 77 | 58 |
| 1047736 | N/A | N/A | 8737 | 8756 | TTGGTGCTTTTGCCCCCTGT | 56 | 59 |
| 1047752 | N/A | N/A | 4093 | 4112 | GGATAGTGCCCCATCAAGAG | 109 | 60 |
| 1047768 | N/A | N/A | 4264 | 4283 | AGTCACAAAGCCCAGCCATG | 95 | 61 |
| 1047784 | N/A | N/A | 4322 | 4341 | GCTTCCAACTCCTCCTTTAT | 101 | 62 |
| 1047800 | N/A | N/A | 4359 | 4378 | CAGAATCCAATCTCCCTCAT | 106 | 63 |
| 1047816 | N/A | N/A | 4405 | 4424 | GCTTTGCGCCCAGACCTGCC | 68 | 64 |
| 1047832 | N/A | N/A | 4525 | 4544 | ATTCCTCTGATCCCAGGTAA | 52 | 65 |
| 1047848 | N/A | N/A | 4704 | 4723 | CCTTAACTCATTACTAAGGT | 69 | 66 |
| 1047864 | N/A | N/A | 4806 | 4825 | GAGACCACCCCCACCCAGGA | 70 | 67 |
| 1047880 | N/A | N/A | 4868 | 4887 | GTCCAGGCTCTTCTGAGGAC | 66 | 68 |
| 1047896 | N/A | N/A | 5007 | 5026 | GTGGCCATCAATCCTTTCCT | 103 | 69 |
| 1047912 | N/A | N/A | 5117 | 5136 | CCCCAGGCTCCTTCTCCCCA | 74 | 70 |
| 1047928 | N/A | N/A | 5388 | 5407 | TGTCTCTACCTGCCAATCTC | 100 | 71 |
| 1047944 | N/A | N/A | 5521 | 5540 | CTCAGGGTACAGGCCACAGC | 90 | 72 |
| 1047960 | N/A | N/A | 5791 | 5810 | ACCCTCCTTCCCCCATTCTC | 94 | 73 |
| 1047976 | N/A | N/A | 5934 | 5953 | AGCTACTACTAATAATAGCA | 98 | 74 |
| 1047992 | N/A | N/A | 6023 | 6042 | ACTTCGGCTCTCTCATCTGT | 75 | 75 |
| 1048008 | N/A | N/A | 6146 | 6165 | AACCCAAAACAGACTGGCAG | 79 | 76 |
| 1048024 | N/A | N/A | 6281 | 6300 | CCCACACTACATATAAGCTC | 105 | 77 |
| 1048040 | N/A | N/A | 6329 | 6348 | CCTGTCCTGCCTAGCCCAAA | 71 | 78 |
| 1048056 | N/A | N/A | 6417 | 6436 | GGGCCCTGCCTCTCTGTGCT | 81 | 79 |
| 1048072 | N/A | N/A | 6544 | 6563 | ATAGCCCTTTCTCCCCTGCC | 86 | 80 |
| 1048088 | N/A | N/A | 6959 | 6978 | AATCCAGAACCTTCCACACT | 114 | 81 |
| 1048104 | N/A | N/A | 7073 | 7092 | TGGGACTTTTCCCAACAACT | 93 | 82 |
| 1048120 | N/A | N/A | 7412 | 7431 | CGCCCTCGACCCAGGTCCTC | 57 | 83 |
| 1048136 | N/A | N/A | 7907 | 7926 | AGTGACTGCCTGCTATGTGT | 94 | 84 |
| 1048152 | N/A | N/A | 7989 | 8008 | TTGGAGGGTGACCCAAGTCC | 81 | 85 |
| 1048168 | N/A | N/A | 8235 | 8254 | ACGCCCTTTTCCTTGCCAGG | 74 | 86 |
| 1048184 | N/A | N/A | 9373 | 9392 | TAGCTCCCCCCTCCCCCCGC | 52 | 87 |
| 1048200 | N/A | N/A | 9534 | 9553 | GCAGTATTACCTCTACTAGT | 45 | 88 |
| 1048216 | N/A | N/A | 9610 | 9629 | CCTGTCCCCTTTCCTCTTTC | 74 | 89 |
| 1048232 | N/A | N/A | 9791 | 9810 | CCACCAACCAGCCACATGAC | 98 | 90 |
| 1048248 | N/A | N/A | 9826 | 9845 | ATCAGGAGACCAGAGCTCAA | 78 | 91 |
| 1048264 | N/A | N/A | 10622 | 10641 | GGCCTGGCTTCATTTCAGCC | 66 | 92 |

TABLE 2-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1048280 | N/A | N/A | 10734 | 10753 | AGTATGAGAACCTATGCAAC | 80 | 93 |
| 1048296 | N/A | N/A | 10793 | 10812 | GGGCATGAGCCATCCTCTCC | 35 | 94 |
| 1048312 | N/A | N/A | 10942 | 10961 | GACTGGGCCCAAATCCCTCC | 87 | 95 |
| 1048328 | N/A | N/A | 11063 | 11082 | CCTTGCTCTCCTCCAGAATT | 67 | 96 |
| 1048344 | N/A | N/A | 11227 | 11246 | GCTACTAACTTTAATTCTCT | 41 | 97 |
| 1048360 | N/A | N/A | 11321 | 11340 | CCTCTTCCCATTCCCCTGGT | 62 | 98 |
| 1048376 | N/A | N/A | 11488 | 11507 | GGTCTTACTTTTCTTGATAG | 72 | 99 |

TABLE 3

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047145 | 18 | 37 | 3466 | 3485 | GCGAGGGCTTTATGAAGGAG | 99 | 100 |
| 1047161 | 133 | 152 | 3581 | 3600 | CGGCCAGGAGCCAGGCCCCC | 82 | 101 |
| 1047177 | 267 | 286 | 3715 | 3734 | TCATCTCTGCCCGCTCACTG | 88 | 102 |
| 1047193 | 490 | 509 | 3938 | 3957 | AGGTCCTGTGCCAGATTGTC | 8* | 103 |
| 1047209 | 585 | 604 | N/A | N/A | TGGCTTCATCTGCTTCCTGT | 5* | 104 |
| 1047225 | 651 | 670 | 5240 | 5259 | TCCTCAAGAACCGGATCTCC | 37 | 105 |
| 1047241 | 821 | 840 | 5707 | 5726 | GCGGTACCACTCTTCGGCTT | 77 | 106 |
| 1047257 | 1051 | 1070 | 7623 | 7642 | CCCTCTTCCTCCAGCCGCGC | 35 | 107 |
| 1047273 | 1252 | 1271 | 10866 | 10885 | CCTTCTGACACAGACTTGGT | 86 | 108 |
| 1047289 | 1305 | 1324 | 10919 | 10938 | CCTCTCCATCCCGCATCTCC | 87 | 109 |
| 1047305 | 1352 | 1371 | 11641 | 11660 | CCTGCCTCACATCACATCCT | 66 | 110 |
| 1047321 | 1417 | 1436 | 11706 | 11725 | GCGGAGCAACTATCCTGCTT | 96 | 111 |
| 1047337 | 1631 | 1650 | 11920 | 11939 | CCTCATTCTAACGCAAGCTG | 58 | 112 |
| 1047353 | 1665 | 1684 | 11954 | 11973 | GTGCCCCCCGCCCTCCTCCC | 46 | 113 |
| 1047369 | 1739 | 1758 | 12028 | 12047 | TCCGAGAGAACCTCCATCTC | 72 | 114 |
| 1047385 | 1792 | 1811 | 12081 | 12100 | CTCAGTTTTCCTCCAGCAGC | 50 | 115 |
| 1047401 | 1876 | 1895 | 12165 | 12184 | TCCCACCTCATAAAAACCAA | 94 | 116 |
| 1047417 | 2059 | 2078 | 12348 | 12367 | GGTGACTGCCCCAGGTGGCA | 68 | 117 |
| 1047433 | 2181 | 2200 | 12470 | 12489 | AGTGCTGAGAATCAAGCTCC | 75 | 118 |
| 1047449 | 2238 | 2257 | 12527 | 12546 | CCCCCCTCTATCCCTCCCAG | 60 | 119 |
| 1047465 | 2310 | 2329 | 12599 | 12618 | GTCCCCTCCAGTCTGCACGG | 49 | 120 |
| 1047481 | 2380 | 2399 | 12669 | 12688 | CTGGTCACCCACAACCCCTA | 82 | 121 |

TABLE 3-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047497 | 2458 | 2477 | 12747 | 12766 | CCCCTTTCTCTCCTGTTTCA | 29 | 122 |
| 1047513 | 2491 | 2510 | 12780 | 12799 | GGACAAAGTCATGCCCTGCC | 85 | 123 |
| 1047529 | 2781 | 2800 | 13070 | 13089 | AGCACCCGGCCTCCAGGCTG | 86 | 124 |
| 1047545 | 2862 | 2881 | 13151 | 13170 | GGGCACAGATCCCACCAGTC | 65 | 125 |
| 1047561 | 2924 | 2943 | 13213 | 13232 | CCCTTCTTCGGCCTTAGAGG | 62 | 126 |
| 1047577 | 3040 | 3059 | 13329 | 13348 | TTTTTCCTCAGCGACTAAAG | 49 | 127 |
| 1047593 | 3060 | 3079 | 13349 | 13368 | GGGCGCAGCATTTGTCTTTA | 59 | 128 |
| 1047609 | N/A | N/A | 8778 | 8797 | GGCTTTTGAGATATCTTGTG | 13 | 129 |
| 1047625 | N/A | N/A | 9036 | 9055 | TGCCAGTTTAATGTACAGTT | 72 | 130 |
| 1047641 | N/A | N/A | 9072 | 9091 | ACCCAAGGACTCACCACCTT | 89 | 131 |
| 1047657 | N/A | N/A | 9212 | 9231 | ATGGAGCCTCAGGGATGAAA | 69 | 132 |
| 1047673 | N/A | N/A | 8382 | 8401 | CCCTGCTGTACTGACCTCGA | 91 | 133 |
| 1047689 | N/A | N/A | 8460 | 8479 | CCTGATCCTCAGTCCCAGTC | 82 | 134 |
| 1047705 | N/A | N/A | 8506 | 8525 | CGCTGCAGTGTCACGAAGGC | 63 | 135 |
| 1047721 | N/A | N/A | 8643 | 8662 | GGCAGATGTCAAGCTCTCAC | 83 | 136 |
| 1047737 | N/A | N/A | 3963 | 3982 | TCCTCACTTCTGCCTCACAG | 66 | 137 |
| 1047753 | N/A | N/A | 4095 | 4114 | AAGGATAGTGCCCCATCAAG | 69 | 138 |
| 1047769 | N/A | N/A | 4265 | 4284 | CAGTCACAAAGCCCAGCCAT | 64 | 139 |
| 1047785 | N/A | N/A | 4324 | 4343 | CCGCTTCCAACTCCTCCTTT | 49 | 140 |
| 1047801 | N/A | N/A | 4361 | 4380 | CCCAGAATCCAATCTCCCTC | 85 | 141 |
| 1047817 | N/A | N/A | 4419 | 4438 | AGGCAGTCACCTGTGCTTTG | 96 | 142 |
| 1047833 | N/A | N/A | 4526 | 4545 | GATTCCTCTGATCCCAGGTA | 63 | 143 |
| 1047849 | N/A | N/A | 4705 | 4724 | GCCTTAACTCATTACTAAGG | 82 | 144 |
| 1047865 | N/A | N/A | 4807 | 4826 | AGAGACCACCCCCACCCAGG | 91 | 145 |
| 1047881 | N/A | N/A | 4910 | 4929 | TGGTTTCATCCTGGAGCCTG | 60 | 146 |
| 1047897 | N/A | N/A | 5012 | 5031 | GGTGGGTGGCCATCAATCCT | 71 | 147 |
| 1047913 | N/A | N/A | 5168 | 5187 | CATCTGCTTCCTGGAGTGGC | 31 | 148 |
| 1047929 | N/A | N/A | 5400 | 5419 | TCTTTCATTTCCTGTCTCTA | 81 | 149 |
| 1047945 | N/A | N/A | 5561 | 5580 | CCCGAACCTCCTGACCAGGG | 117 | 150 |
| 1047961 | N/A | N/A | 5800 | 5819 | GCTTCCTCCACCCTCCTTCC | 75 | 151 |
| 1047977 | N/A | N/A | 5935 | 5954 | CAGCTACTACTAATAATAGC | 104 | 152 |
| 1047993 | N/A | N/A | 6040 | 6059 | TTAGTTAACCTCTCTGGACT | 79 | 153 |
| 1048009 | N/A | N/A | 6147 | 6166 | TAACCCAAAACAGACTGGCA | 101 | 154 |
| 1048025 | N/A | N/A | 6282 | 6301 | TCCCACACTACATATAAGCT | 83 | 155 |
| 1048041 | N/A | N/A | 6330 | 6349 | GCCTGTCCTGCCTAGCCCAA | 80 | 156 |

TABLE 3-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1048057 | N/A | N/A | 6464 | 6483 | GCCACTCACACTCCTCAGCT | 79 | 157 |
| 1048073 | N/A | N/A | 6548 | 6567 | TCTAATAGCCCTTTCTCCCC | 88 | 158 |
| 1048089 | N/A | N/A | 6961 | 6980 | AGAATCCAGAACCTTCCACA | 88 | 159 |
| 1048105 | N/A | N/A | 7074 | 7093 | CTGGGACTTTTCCCAACAAC | 86 | 160 |
| 1048121 | N/A | N/A | 7418 | 7437 | AGGCCCCGCCCTCGACCCAG | 95 | 161 |
| 1048137 | N/A | N/A | 7915 | 7934 | AAACATCTAGTGACTGCCTG | 87 | 162 |
| 1048153 | N/A | N/A | 8061 | 8080 | AAGGAGGCAGAAGAGATGGG | 59 | 163 |
| 1048169 | N/A | N/A | 8286 | 8305 | CTGGGACACCCCTAGGCTGG | 68 | 164 |
| 1048185 | N/A | N/A | 9374 | 9393 | TTAGCTCCCCCCTCCCCCCG | 84 | 165 |
| 1048201 | N/A | N/A | 9536 | 9555 | TGGCAGTATTACCTCTACTA | 43 | 166 |
| 1048217 | N/A | N/A | 9611 | 9630 | TCCTGTCCCCTTTCCTCTTT | 63 | 167 |
| 1048233 | N/A | N/A | 9792 | 9811 | GCCACCAACCAGCCACATGA | 89 | 168 |
| 1048249 | N/A | N/A | 10005 | 10024 | CTGTAATCCCCTTACTCGGG | 94 | 169 |
| 1048265 | N/A | N/A | 10636 | 10655 | CTGCTCTGTCTTCTGGCCTG | 65 | 170 |
| 1048281 | N/A | N/A | 10735 | 10754 | GAGTATGAGAACCTATGCAA | 53 | 171 |
| 1048297 | N/A | N/A | 10794 | 10813 | AGGGCATGAGCCATCCTCTC | 78 | 172 |
| 1048313 | N/A | N/A | 10944 | 10963 | CTGACTGGGCCCAAATCCCT | 95 | 173 |
| 1048329 | N/A | N/A | 11074 | 11093 | ACATTCAGTTTCCTTGCTCT | 89 | 174 |
| 1048345 | N/A | N/A | 11228 | 11247 | AGCTACTAACTTTAATTCTC | 82 | 175 |
| 1048361 | N/A | N/A | 11330 | 11349 | GCCAAATCCCCTCTTCCCAT | 19 | 176 |
| 1048377 | N/A | N/A | 11491 | 11510 | CCAGGTCTTACTTTTCTTGA | 85 | 177 |

TABLE 4

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047146 | 58 | 77 | 3506 | 3525 | CTCCTCTCCATCCTGCTCTG | 94 | 178 |
| 1047162 | 138 | 157 | 3586 | 3605 | GACGGCGGCCAGGAGCCAGG | 115 | 179 |
| 1047178 | 274 | 293 | 3722 | 3741 | AGCTCCATCATCTCTGCCCG | 117 | 180 |
| 1047194 | 495 | 514 | 3943 | 3962 | TGGCCAGGTCCTGTGCCAGA | 67* | 181 |
| 1047210 | 588 | 607 | 5177 | 5196 | GGGTGGCTTCATCTGCTTCC | 18* | 182 |
| 1047226 | 656 | 675 | 5245 | 5264 | GATCTTCCTCAAGAACCGGA | 62 | 183 |
| 1047242 | 822 | 841 | 5708 | 5727 | AGCGGTACCACTCTTCGGCT | 113 | 184 |
| 1047258 | 1052 | 1071 | 7624 | 7643 | CCCCTCTTCCTCCAGCCGCG | 16 | 185 |

TABLE 4-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047274 | 1253 | 1272 | 10867 | 10886 | GCCTTCTGACACAGACTTGG | 113 | 186 |
| 1047290 | 1309 | 1328 | N/A | N/A | ATGACCTCTCCATCCCGCAT | 108 | 187 |
| 1047306 | 1353 | 1372 | 11642 | 11661 | TCCTGCCTCACATCACATCC | 75 | 188 |
| 1047322 | 1499 | 1518 | 11788 | 11807 | GCAAGCTGACCTAGGGACAG | 68 | 189 |
| 1047338 | 1632 | 1651 | 11921 | 11940 | TCCTCATTCTAACGCAAGCT | 68 | 190 |
| 1047354 | 1666 | 1685 | 11955 | 11974 | GGTGCCCCCCGCCCTCCTCC | 90 | 191 |
| 1047370 | 1740 | 1759 | 12029 | 12048 | CTCCGAGAGAACCTCCATCT | 77 | 192 |
| 1047386 | 1793 | 1812 | 12082 | 12101 | TCTCAGTTTTCCTCCAGCAG | 33 | 193 |
| 1047402 | 1888 | 1907 | 12177 | 12196 | AGCATAGGGATATCCCACCT | 63 | 194 |
| 1047418 | 2063 | 2082 | 12352 | 12371 | GGCAGGTGACTGCCCCAGGT | 106 | 195 |
| 1047434 | 2182 | 2201 | 12471 | 12490 | AAGTGCTGAGAATCAAGCTC | 103 | 196 |
| 1047450 | 2239 | 2258 | 12528 | 12547 | GCCCCCCTCTATCCCTCCCA | 103 | 197 |
| 1047466 | 2329 | 2348 | 12618 | 12637 | CTCCTCCATCTCTACCAGCG | 52 | 198 |
| 1047482 | 2381 | 2400 | 12670 | 12689 | ACTGGTCACCCACAACCCCT | 79 | 199 |
| 1047498 | 2461 | 2480 | 12750 | 12769 | CATCCCCTTTCTCTCCTGTT | 74 | 200 |
| 1047514 | 2532 | 2551 | 12821 | 12840 | CGGCCTGGTATGACACAGCA | 91 | 201 |
| 1047530 | 2782 | 2801 | 13071 | 13090 | GAGCACCCGGCCTCCAGGCT | 80 | 202 |
| 1047546 | 2864 | 2883 | 13153 | 13172 | CTGGGCACAGATCCCACCAG | 107 | 203 |
| 1047562 | 2927 | 2946 | 13216 | 13235 | GGACCCTTCTTCGGCCTTAG | 69 | 204 |
| 1047578 | 3043 | 3062 | 13332 | 13351 | TTATTTTTCCTCAGCGACTA | 75 | 205 |
| 1047594 | 3062 | 3081 | 13351 | 13370 | AAGGGCGCAGCATTTGTCTT | 86 | 206 |
| 1047610 | N/A | N/A | 8782 | 8801 | GTGAGGCTTTTGAGATATCT | 33 | 207 |
| 1047626 | N/A | N/A | 9038 | 9057 | TCTGCCAGTTTAATGTACAG | 114 | 208 |
| 1047642 | N/A | N/A | 9078 | 9097 | CTGCGCACCCAAGGACTCAC | 96 | 209 |
| 1047658 | N/A | N/A | 9257 | 9276 | CCTGAGGGAAGAATCCTCTG | 86 | 210 |
| 1047674 | N/A | N/A | 8390 | 8409 | CCACGAGGCCCTGCTGTACT | 111 | 211 |
| 1047690 | N/A | N/A | 8461 | 8480 | CCCTGATCCTCAGTCCCAGT | 82 | 212 |
| 1047706 | N/A | N/A | 8534 | 8553 | CCCTGGTATGATAGGCTCTG | 62 | 213 |
| 1047722 | N/A | N/A | 8645 | 8664 | AGGGCAGATGTCAAGCTCTC | 110 | 214 |
| 1047738 | N/A | N/A | 3968 | 3987 | TCCCCTCCTCACTTCTGCCT | 91 | 215 |
| 1047754 | N/A | N/A | 4097 | 4116 | GCAAGGATAGTGCCCCATCA | 94 | 216 |
| 1047770 | N/A | N/A | 4268 | 4287 | CCACAGTCACAAAGCCCAGC | 84 | 217 |
| 1047786 | N/A | N/A | 4325 | 4344 | TCCGCTTCCAACTCCTCCTT | 107 | 218 |
| 1047802 | N/A | N/A | 4362 | 4381 | CCCCAGAATCCAATCTCCCT | 84 | 219 |
| 1047818 | N/A | N/A | 4477 | 4496 | CCACCGCTTCACAGCTGTGC | 77 | 220 |

TABLE 4-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047834 | N/A | N/A | 4528 | 4547 | GGGATTCCTCTGATCCCAGG | 93 | 221 |
| 1047850 | N/A | N/A | 4706 | 4725 | TGCCTTAACTCATTACTAAG | 64 | 222 |
| 1047866 | N/A | N/A | 4809 | 4828 | ACAGAGACCACCCCCACCCA | 63 | 223 |
| 1047882 | N/A | N/A | 4959 | 4978 | CTGACCTGTCTATAGGCAGC | 89* | 224 |
| 1047898 | N/A | N/A | 5085 | 5104 | GCCTTACCCCTCCTTCTGGG | 100 | 225 |
| 1047914 | N/A | N/A | 5268 | 5287 | TGCCCTGGCCTCACCTCCTC | 98 | 226 |
| 1047930 | N/A | N/A | 5401 | 5420 | GTCTTTCATTTCCTGTCTCT | 55 | 227 |
| 1047946 | N/A | N/A | 5562 | 5581 | TCCCGAACCTCCTGACCAGG | 117 | 228 |
| 1047962 | N/A | N/A | 5803 | 5822 | CCAGCTTCCTCCACCCTCCT | 137 | 229 |
| 1047978 | N/A | N/A | 5936 | 5955 | TCAGCTACTACTAATAATAG | 91 | 230 |
| 1047994 | N/A | N/A | 6077 | 6096 | AACTCTACCACTTAGGAGCT | 130 | 231 |
| 1048010 | N/A | N/A | 6148 | 6167 | GTAACCCAAAACAGACTGGC | 85 | 232 |
| 1048026 | N/A | N/A | 6283 | 6302 | CTCCCACACTACATATAAGC | 82 | 233 |
| 1048042 | N/A | N/A | 6331 | 6350 | TGCCTGTCCTGCCTAGCCCA | 72 | 234 |
| 1048058 | N/A | N/A | 6467 | 6486 | TCTGCCACTCACACTCCTCA | 95 | 235 |
| 1048074 | N/A | N/A | 6549 | 6568 | TTCTAATAGCCCTTTCTCCC | 83 | 236 |
| 1048090 | N/A | N/A | 6990 | 7009 | TCAGCAAGCGAATGAATGAA | 157 | 237 |
| 1048106 | N/A | N/A | 7075 | 7094 | GCTGGGACTTTTCCCAACAA | 91 | 238 |
| 1048122 | N/A | N/A | 7449 | 7468 | AGGCCCCGCCTCTAGCCCGG | 110 | 239 |
| 1048138 | N/A | N/A | 7920 | 7939 | TCATCAAACATCTAGTGACT | 91 | 240 |
| 1048154 | N/A | N/A | 8112 | 8131 | TCTATCTGAAGGAAGATGGA | 90 | 241 |
| 1048170 | N/A | N/A | 8329 | 8348 | GTGATCCTGAAAGAAAGCAG | 68 | 242 |
| 1048186 | N/A | N/A | 9375 | 9394 | TTTAGCTCCCCCCTCCCCCC | 126 | 243 |
| 1048202 | N/A | N/A | 9566 | 9585 | TGCTTTAGTGACCTGTGACT | 74 | 244 |
| 1048218 | N/A | N/A | 9614 | 9633 | CTTTCCTGTCCCCTTTCCTC | 134 | 245 |
| 1048234 | N/A | N/A | 9793 | 9812 | AGCCACCAACCAGCCACATG | 83 | 246 |
| 1048250 | N/A | N/A | 10006 | 10025 | CCTGTAATCCCCTTACTCGG | 92 | 247 |
| 1048266 | N/A | N/A | 10652 | 10671 | GCTGCCAGAGTCCTGGCTGC | 81 | 248 |
| 1048282 | N/A | N/A | 10742 | 10761 | CCATCATGAGTATGAGAACC | 88 | 249 |
| 1048298 | N/A | N/A | 10814 | 10833 | GAGGCCTCTCATGGACTTTC | 84 | 250 |
| 1048314 | N/A | N/A | 10953 | 10972 | AGCCAGAGCCTGACTGGGCC | 80 | 251 |
| 1048330 | N/A | N/A | 11080 | 11099 | GGAATTACATTCAGTTTCCT | 72 | 252 |
| 1048346 | N/A | N/A | 11268 | 11287 | CTCCCCATCCCCAACTGTGT | 107 | 253 |
| 1048362 | N/A | N/A | 11331 | 11350 | CGCCAAATCCCCTCTTCCCA | 106 | 254 |
| 1048378 | N/A | N/A | 11492 | 11511 | CCCAGGTCTTACTTTTCTTG | 80 | 255 |

TABLE 5

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047147 | 61 | 80 | 3509 | 3528 | CGTCTCCTCTCCATCCTGCT | 74 | 256 |
| 1047163 | 139 | 158 | 3587 | 3606 | AGACGGCGGCCAGGAGCCAG | 100 | 257 |
| 1047179 | 275 | 294 | 3723 | 3742 | GAGCTCCATCATCTCTGCCC | 116 | 258 |
| 1047195 | 500 | 519 | 3948 | 3967 | CACAGTGGCCAGGTCCTGTG | 70* | 259 |
| 1047211 | 589 | 608 | 5178 | 5197 | AGGGTGGCTTCATCTGCTTC | 37* | 260 |
| 1047227 | 657 | 676 | 5246 | 5265 | GGATCTTCCTCAAGAACCGG | 90 | 261 |
| 1047243 | 823 | 842 | 5709 | 5728 | GAGCGGTACCACTCTTCGGC | 83 | 262 |
| 1047259 | 1054 | 1073 | 7626 | 7645 | TGCCCCTCTTCCTCCAGCCG | 63 | 263 |
| 1047275 | 1254 | 1273 | 10868 | 10887 | GGCCTTCTGACACAGACTTG | 116 | 264 |
| 1047291 | 1311 | 1330 | N/A | N/A | TAATGACCTCTCCATCCCGC | 91 | 265 |
| 1047307 | 1354 | 1373 | 11643 | 11662 | GTCCTGCCTCACATCACATC | 88 | 266 |
| 1047323 | 1524 | 1543 | 11813 | 11832 | CCTGATACTGACGGAGCCTA | 56 | 267 |
| 1047339 | 1633 | 1652 | 11922 | 11941 | CTCCTCATTCTAACGCAAGC | 116 | 268 |
| 1047355 | 1668 | 1687 | 11957 | 11976 | TAGGTGCCCCCCGCCCTCCT | 68 | 269 |
| 1047371 | 1754 | 1773 | 12043 | 12062 | ACAGTTCCCAGATACTCCGA | 80 | 270 |
| 1047387 | 1794 | 1813 | 12083 | 12102 | GTCTCAGTTTTCCTCCAGCA | 12 | 271 |
| 1047403 | 1966 | 1985 | 12255 | 12274 | CCAATCTATAATCCCAGCTA | 89 | 272 |
| 1047419 | 2065 | 2084 | 12354 | 12373 | TGGGCAGGTGACTGCCCCAG | 110 | 273 |
| 1047435 | 2192 | 2211 | 12481 | 12500 | CAGATCCCCCAAGTGCTGAG | 87 | 274 |
| 1047451 | 2240 | 2259 | 12529 | 12548 | AGCCCCCCTCTATCCCTCCC | 97 | 275 |
| 1047467 | 2335 | 2354 | 12624 | 12643 | TGCCTCCTCCTCCATCTCTA | 72 | 276 |
| 1047483 | 2384 | 2403 | 12673 | 12692 | GCAACTGGTCACCCACAACC | 49 | 277 |
| 1047499 | 2462 | 2481 | 12751 | 12770 | ACATCCCCTTTCTCTCCTGT | 77 | 278 |
| 1047515 | 2675 | 2694 | 12964 | 12983 | TTTGTGTGTGAGTAAGAAGG | 49 | 279 |
| 1047531 | 2785 | 2804 | 13074 | 13093 | CCTGAGCACCCGGCCTCCAG | 80 | 280 |
| 1047547 | 2865 | 2884 | 13154 | 13173 | TCTGGGCACAGATCCCACCA | 85 | 281 |
| 1047563 | 2928 | 2947 | 13217 | 13236 | AGGACCCTTCTTCGGCCTTA | 70 | 282 |
| 1047579 | 3044 | 3063 | 13333 | 13352 | TTTATTTTTCCTCAGCGACT | 47 | 283 |
| 1047611 | N/A | N/A | 8826 | 8845 | TTCCATTTACAATCTGGTGA | 93 | 285 |
| 1047627 | N/A | N/A | 9040 | 9059 | GCTCTGCCAGTTTAATGTAC | 128 | 286 |
| 1047643 | N/A | N/A | 9079 | 9098 | ACTGCGCACCCAAGGACTCA | 77 | 287 |
| 1047659 | N/A | N/A | 9283 | 9302 | ACTTTATTCACTGCAAGAGC | 65 | 288 |
| 1047675 | N/A | N/A | 8398 | 8417 | TGCCCTTCCCACGAGGCCCT | 53 | 289 |
| 1047691 | N/A | N/A | 8462 | 8481 | GCCCTGATCCTCAGTCCCAG | 92 | 290 |
| 1047707 | N/A | N/A | 8535 | 8554 | ACCCTGGTATGATAGGCTCT | 46 | 291 |
| 1047723 | N/A | N/A | 8662 | 8681 | CTCAGGGATCTGCAGACAGG | 81 | 292 |

TABLE 5-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047739 | N/A | N/A | 3969 | 3988 | ATCCCCTCCTCACTTCTGCC | 85* | 293 |
| 1047755 | N/A | N/A | 4119 | 4138 | GTCCCTCCCATCATGTTGGG | 83 | 294 |
| 1047771 | N/A | N/A | 4270 | 4289 | GCCCACAGTCACAAAGCCCA | 68 | 295 |
| 1047787 | N/A | N/A | 4327 | 4346 | TCTCCGCTTCCAACTCCTCC | 109 | 296 |
| 1047803 | N/A | N/A | 4363 | 4382 | ACCCCAGAATCCAATCTCCC | 81 | 297 |
| 1047819 | N/A | N/A | 4503 | 4522 | ACCTTTTGAAATGAATTTTA | 65 | 298 |
| 1047835 | N/A | N/A | 4588 | 4607 | CTCCTGCACTTGAAGGCACA | 101 | 299 |
| 1047851 | N/A | N/A | 4707 | 4726 | TTGCCTTAACTCATTACTAA | 77 | 300 |
| 1047867 | N/A | N/A | 4811 | 4830 | TCACAGAGACCACCCCCACC | 97 | 301 |
| 1047883 | N/A | N/A | 4964 | 4983 | CCTCCCTGACCTGTCTATAG | 103* | 302 |
| 1047899 | N/A | N/A | 5086 | 5105 | TGCCTTACCCCTCCTTCTGG | 76 | 303 |
| 1047915 | N/A | N/A | 5270 | 5289 | TCTGCCCTGGCCTCACCTCC | 102 | 304 |
| 1047931 | N/A | N/A | 5403 | 5422 | TTGTCTTTCATTTCCTGTCT | 67 | 305 |
| 1047947 | N/A | N/A | 5563 | 5582 | TTCCCGAACCTCCTGACCAG | 131 | 306 |
| 1047963 | N/A | N/A | 5804 | 5823 | CCCAGCTTCCTCCACCCTCC | 58 | 307 |
| 1047979 | N/A | N/A | 5937 | 5956 | ATCAGCTACTACTAATAATA | 128 | 308 |
| 1047995 | N/A | N/A | 6078 | 6097 | CAACTCTACCACTTAGGAGC | 97 | 309 |
| 1048011 | N/A | N/A | 6150 | 6169 | CAGTAACCCAAAACAGACTG | 85 | 310 |
| 1048027 | N/A | N/A | 6284 | 6303 | GCTCCCACACTACATATAAG | 48 | 311 |
| 1048043 | N/A | N/A | 6352 | 6371 | CTTCTCTTCCTGTCCACAGC | 93 | 312 |
| 1048059 | N/A | N/A | 6471 | 6490 | GGCTTCTGCCACTCACACTC | 85 | 313 |
| 1048075 | N/A | N/A | 6550 | 6569 | GTTCTAATAGCCCTTTCTCC | 124 | 314 |
| 1048091 | N/A | N/A | 6991 | 7010 | GTCAGCAAGCGAATGAATGA | 85 | 315 |
| 1048107 | N/A | N/A | 7109 | 7128 | CAGCACCCCAGTTAACCCCA | 73 | 316 |
| 1048123 | N/A | N/A | 7450 | 7469 | CAGGCCCCGCCTCTAGCCCG | 88 | 317 |
| 1048139 | N/A | N/A | 7928 | 7947 | CCATTCAGTCATCAAACATC | 76 | 318 |
| 1048155 | N/A | N/A | 8120 | 8139 | GGCGCATGTCTATCTGAAGG | 76 | 319 |
| 1048171 | N/A | N/A | 8330 | 8349 | GGTGATCCTGAAAGAAAGCA | 103 | 320 |
| 1048187 | N/A | N/A | 9391 | 9410 | TGCAAGTAAAAAGTAATTTA | 69 | 321 |
| 1048203 | N/A | N/A | 9568 | 9587 | TGTGCTTTAGTGACCTGTGA | 31 | 322 |
| 1048219 | N/A | N/A | 9619 | 9638 | GGTCCCTTTCCTGTCCCCTT | 53 | 323 |
| 1048235 | N/A | N/A | 9794 | 9813 | TAGCCACCAACCAGCCACAT | 97 | 324 |
| 1048251 | N/A | N/A | 10007 | 10026 | ACCTGTAATCCCCTTACTCG | 89 | 325 |
| 1048267 | N/A | N/A | 10657 | 10676 | GTGCTGCTGCCAGAGTCCTG | 35 | 326 |
| 1048283 | N/A | N/A | 10750 | 10769 | CCCCCTCCCCATCATGAGTA | 100 | 327 |

TABLE 5-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1048299 | N/A | N/A | 10841 | 10860 | GGCTGGTTTCTGCAGATGTG | 87 | 328 |
| 1048315 | N/A | N/A | 10954 | 10973 | CAGCCAGAGCCTGACTGGGC | 188 | 329 |
| 1048331 | N/A | N/A | 11086 | 11105 | GGAAACGGAATTACATTCAG | 130 | 330 |
| 1048347 | N/A | N/A | 11269 | 11288 | CCTCCCCATCCCCAACTGTG | 99 | 331 |
| 1048363 | N/A | N/A | 11332 | 11351 | ACGCCAAATCCCCTCTTCCC | 93 | 332 |
| 1048379 | N/A | N/A | 11501 | 11520 | CCCCGACTTCCCAGGTCTTA | 91 | 333 |

TABLE 6

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047148 | 112 | 131 | 3560 | 3579 | ACCATCATCTCCCCTGAGGA | 116 | 334 |
| 1047164 | 150 | 169 | 3598 | 3617 | TGCCAGGACCCAGACGGCGG | 96 | 335 |
| 1047180 | 277 | 296 | 3725 | 3744 | TTGAGCTCCATCATCTCTGC | 123 | 336 |
| 1047196 | 503 | 522 | 3951 | 3970 | CCTCACAGTGGCCAGGTCCT | 27* | 337 |
| 1047212 | 615 | 634 | 5204 | 5223 | TCTTCCTCTCCAGATCCAGA | 77 | 338 |
| 1047228 | 658 | 677 | 5247 | 5266 | TGGATCTTCCTCAAGAACCG | 75 | 339 |
| 1047244 | 824 | 843 | 5710 | 5729 | GGAGCGGTACCACTCTTCGG | 74 | 340 |
| 1047260 | 1058 | 1077 | 7630 | 7649 | GCTCTGCCCCTCTTCCTCCA | 82 | 341 |
| 1047276 | 1255 | 1274 | 10869 | 10888 | TGGCCTTCTGACACAGACTT | 137 | 342 |
| 1047292 | 1312 | 1331 | N/A | N/A | TTAATGACCTCTCCATCCCG | 81 | 343 |
| 1047308 | 1356 | 1375 | 11645 | 11664 | GGGTCCTGCCTCACATCACA | 69 | 344 |
| 1047324 | 1526 | 1545 | 11815 | 11834 | GGCCTGATACTGACGGAGCC | 73 | 345 |
| 1047340 | 1634 | 1653 | 11923 | 11942 | CCTCCTCATTCTAACGCAAG | 63 | 346 |
| 1047356 | 1672 | 1691 | 11961 | 11980 | GTAGTAGGTGCCCCCCGCCC | 84 | 347 |
| 1047372 | 1755 | 1774 | 12044 | 12063 | CACAGTTCCCAGATACTCCG | 49 | 348 |
| 1047388 | 1795 | 1814 | 12084 | 12103 | AGTCTCAGTTTTCCTCCAGC | 24 | 349 |
| 1047404 | 1999 | 2018 | 12288 | 12307 | GGAGAACAACCCTCTGAGCT | 75 | 350 |
| 1047420 | 2101 | 2120 | 12390 | 12409 | CACTTGAGTCATCGCTCAGG | 107 | 351 |
| 1047436 | 2193 | 2212 | 12482 | 12501 | ACAGATCCCCCAAGTGCTGA | 73 | 352 |
| 1047452 | 2241 | 2260 | 12530 | 12549 | CAGCCCCCCTCTATCCCTCC | 88 | 353 |
| 1047468 | 2337 | 2356 | 12626 | 12645 | ATTGCCTCCTCCTCCATCTC | 93 | 354 |
| 1047484 | 2395 | 2414 | 12684 | 12703 | AGAGGCCAAGTGCAACTGGT | 80 | 355 |
| 1047500 | 2463 | 2482 | 12752 | 12771 | TACATCCCCTTTCTCTCCTG | 47 | 356 |

TABLE 6-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047516 | 2699 | 2718 | 12988 | 13007 | CACTACCTAGAATACTGGGT | 92 | 357 |
| 1047532 | 2794 | 2813 | 13083 | 13102 | CGTGTCAGCCCTGAGCACCC | 129 | 358 |
| 1047548 | 2866 | 2885 | 13155 | 13174 | CTCTGGGCACAGATCCCACC | 141 | 359 |
| 1047564 | 2931 | 2950 | 13220 | 13239 | GGAAGGACCCTTCTTCGGCC | 67 | 360 |
| 1047580 | 3045 | 3064 | 13334 | 13353 | CTTTATTTTTCCTCAGCGAC | 35 | 361 |
| 1047612 | N/A | N/A | 8827 | 8846 | GTTCCATTTACAATCTGGTG | 60 | 363 |
| 1047628 | N/A | N/A | 9053 | 9072 | TTACCACTAACAAGCTCTGC | 76 | 364 |
| 1047644 | N/A | N/A | 9081 | 9100 | CCACTGCGCACCCAAGGACT | 89 | 365 |
| 1047660 | N/A | N/A | 9290 | 9309 | ACATAAAACTTTATTCACTG | 74 | 366 |
| 1047676 | N/A | N/A | 8399 | 8418 | GTGCCCTTCCCACGAGGCCC | 176 | 367 |
| 1047692 | N/A | N/A | 8463 | 8482 | TGCCCTGATCCTCAGTCCCA | 81 | 368 |
| 1047708 | N/A | N/A | 8536 | 8555 | TACCCTGGTATGATAGGCTC | 60 | 369 |
| 1047724 | N/A | N/A | 8669 | 8688 | GTGCTTGCTCAGGGATCTGC | 56 | 370 |
| 1047740 | N/A | N/A | 3971 | 3990 | CCATCCCCTCCTCACTTCTG | 85* | 371 |
| 1047756 | N/A | N/A | 4120 | 4139 | GGTCCCTCCCATCATGTTGG | 76 | 372 |
| 1047772 | N/A | N/A | 4272 | 4291 | CTGCCCACAGTCACAAAGCC | 103 | 373 |
| 1047788 | N/A | N/A | 4328 | 4347 | TTCTCCGCTTCCAACTCCTC | 133 | 374 |
| 1047804 | N/A | N/A | 4364 | 4383 | CACCCCAGAATCCAATCTCC | 78 | 375 |
| 1047820 | N/A | N/A | 4507 | 4526 | AACCACCTTTTGAAATGAAT | 118 | 376 |
| 1047836 | N/A | N/A | 4596 | 4615 | CACATGTCCTCCTGCACTTG | 108 | 377 |
| 1047852 | N/A | N/A | 4708 | 4727 | TTTGCCTTAACTCATTACTA | 91 | 378 |
| 1047868 | N/A | N/A | 4812 | 4831 | GTCACAGAGACCACCCCCAC | 108 | 379 |
| 1047884 | N/A | N/A | 4965 | 4984 | ACCTCCCTGACCTGTCTATA | 83 | 380 |
| 1047900 | N/A | N/A | 5087 | 5106 | TTGCCTTACCCCTCCTTCTG | 102 | 381 |
| 1047916 | N/A | N/A | 5282 | 5301 | AGCTTTCCTCCCTCTGCCCT | 92 | 382 |
| 1047932 | N/A | N/A | 5405 | 5424 | GTTTGTCTTTCATTTCCTGT | 82 | 383 |
| 1047948 | N/A | N/A | 5564 | 5583 | GTTCCCGAACCTCCTGACCA | 103 | 384 |
| 1047964 | N/A | N/A | 5805 | 5824 | TCCCAGCTTCCTCCACCCTC | 78 | 385 |
| 1047980 | N/A | N/A | 5938 | 5957 | TATCAGCTACTACTAATAAT | 106 | 386 |
| 1047996 | N/A | N/A | 6079 | 6098 | CCAACTCTACCACTTAGGAG | 96 | 387 |
| 1048012 | N/A | N/A | 6151 | 6170 | TCAGTAACCCAAAACAGACT | 124 | 388 |
| 1048028 | N/A | N/A | 6285 | 6304 | GGCTCCCACACTACATATAA | 134 | 389 |
| 1048044 | N/A | N/A | 6353 | 6372 | TCTTCTCTTCCTGTCCACAG | 93 | 390 |
| 1048060 | N/A | N/A | 6473 | 6492 | GTGGCTTCTGCCACTCACAC | 129 | 391 |
| 1048076 | N/A | N/A | 6556 | 6575 | CCCTGGGTTCTAATAGCCCT | 89 | 392 |

TABLE 6-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1048092 | N/A | N/A | 6993 | 7012 | TGGTCAGCAAGCGAATGAAT | 81 | 393 |
| 1048108 | N/A | N/A | 7111 | 7130 | AGCAGCACCCCAGTTAACCC | 104 | 394 |
| 1048124 | N/A | N/A | 7451 | 7470 | CCAGGCCCCGCCTCTAGCCC | 89 | 395 |
| 1048140 | N/A | N/A | 7932 | 7951 | CCATCCATTCAGTCATCAAA | 70 | 396 |
| 1048156 | N/A | N/A | 8142 | 8161 | GGCTTGAGTGTTATCTGGGA | 74 | 397 |
| 1048172 | N/A | N/A | 8332 | 8351 | ATGGTGATCCTGAAAGAAAG | 87 | 398 |
| 1048188 | N/A | N/A | 9392 | 9411 | ATGCAAGTAAAAAGTAATTT | 61 | 399 |
| 1048204 | N/A | N/A | 9581 | 9600 | TCTGCCATTTATCTGTGCTT | 61 | 400 |
| 1048220 | N/A | N/A | 9621 | 9640 | TAGGTCCCTTTCCTGTCCCC | 60 | 401 |
| 1048236 | N/A | N/A | 9795 | 9814 | TTAGCCACCAACCAGCCACA | 106 | 402 |
| 1048252 | N/A | N/A | 10009 | 10028 | GCACCTGTAATCCCCTTACT | 76 | 403 |
| 1048268 | N/A | N/A | 10658 | 10677 | AGTGCTGCTGCCAGAGTCCT | 80 | 404 |
| 1048284 | N/A | N/A | 10751 | 10770 | CCCCCCTCCCCATCATGAGT | 82 | 405 |
| 1048300 | N/A | N/A | 10921 | 10940 | TACCTCTCCATCCCGCATCT | 109 | 406 |
| 1048316 | N/A | N/A | 10976 | 10995 | TGGCCTTGAGAATCCCTGGG | 99 | 407 |
| 1048332 | N/A | N/A | 11090 | 11109 | CTGAGGAAACGGAATTACAT | 83 | 408 |
| 1048348 | N/A | N/A | 11272 | 11291 | AGCCCTCCCCATCCCCAACT | 121 | 409 |
| 1048364 | N/A | N/A | 11333 | 11352 | TACGCCAAATCCCCTCTTCC | 92 | 410 |
| 1048380 | N/A | N/A | 11504 | 11523 | AGTCCCCGACTTCCCAGGTC | 116 | 411 |

TABLE 7

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047149 | 113 | 132 | 3561 | 3580 | CACCATCATCTCCCCTGAGG | 102 | 412 |
| 1047165 | 151 | 170 | 3599 | 3618 | GTGCCAGGACCCAGACGGCG | 120 | 413 |
| 1047181 | 279 | 298 | 3727 | 3746 | CATTGAGCTCCATCATCTCT | 92 | 414 |
| 1047197 | 525 | 544 | N/A | N/A | TGGTTTCATCCTGGAGCTTC | 39* | 415 |
| 1047213 | 617 | 636 | 5206 | 5225 | AATCTTCCTCTCCAGATCCA | 79 | 416 |
| 1047229 | 659 | 678 | 5248 | 5267 | GTGGATCTTCCTCAAGAACC | 83 | 417 |
| 1047245 | 825 | 844 | 5711 | 5730 | TGGAGCGGTACCACTCTTCG | 77 | 418 |
| 1047261 | 1060 | 1079 | 7632 | 7651 | AGGCTCTGCCCCTCTTCCTC | 78 | 419 |
| 1047277 | 1257 | 1276 | 10871 | 10890 | GGTGGCCTTCTGACACAGAC | 98 | 420 |
| 1047293 | 1313 | 1332 | N/A | N/A | CTTAATGACCTCTCCATCCC | 105 | 421 |

TABLE 7-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047309 | 1357 | 1376 | 11646 | 11665 | TGGGTCCTGCCTCACATCAC | 154 | 422 |
| 1047325 | 1529 | 1548 | 11818 | 11837 | GCAGGCCTGATACTGACGGA | 46 | 423 |
| 1047341 | 1635 | 1654 | 11924 | 11943 | TCCTCCTCATTCTAACGCAA | 53 | 424 |
| 1047357 | 1684 | 1703 | 11973 | 11992 | GTGGAGGGCGATGTAGTAGG | 42 | 425 |
| 1047373 | 1756 | 1775 | 12045 | 12064 | GCACAGTTCCCAGATACTCC | 33 | 426 |
| 1047389 | 1812 | 1831 | 12101 | 12120 | CTTCCCTTTCCTGTCTGAGT | 64 | 427 |
| 1047405 | 2003 | 2022 | 12292 | 12311 | TCTAGGAGAACAACCCTCTG | 160 | 428 |
| 1047421 | 2103 | 2122 | 12392 | 12411 | GACACTTGAGTCATCGCTCA | 63 | 429 |
| 1047437 | 2194 | 2213 | 12483 | 12502 | AACAGATCCCCCAAGTGCTG | 85 | 430 |
| 1047453 | 2242 | 2261 | 12531 | 12550 | GCAGCCCCCCTCTATCCCTC | 173 | 431 |
| 1047469 | 2341 | 2360 | 12630 | 12649 | CCCAATTGCCTCCTCCTCCA | 53 | 432 |
| 1047485 | 2407 | 2426 | 12696 | 12715 | TTCCCACAATCCAGAGGCCA | 101 | 433 |
| 1047501 | 2464 | 2483 | 12753 | 12772 | ATACATCCCCTTTCTCTCCT | 63 | 434 |
| 1047517 | 2701 | 2720 | 12990 | 13009 | GGCACTACCTAGAATACTGG | 73 | 435 |
| 1047533 | 2833 | 2852 | 13122 | 13141 | GTCTGCTCAGTCAAAGCAGA | 93 | 436 |
| 1047549 | 2877 | 2896 | 13166 | 13185 | CCCAGTCCCATCTCTGGGCA | 134 | 437 |
| 1047565 | 2932 | 2951 | 13221 | 13240 | GGGAAGGACCCTTCTTCGGC | 66 | 438 |
| 1047581 | 3046 | 3065 | 13335 | 13354 | TCTTTATTTTTCCTCAGCGA | 41 | 439 |
| 1047613 | N/A | N/A | 8828 | 8847 | CGTTCCATTTACAATCTGGT | 47 | 441 |
| 1047629 | N/A | N/A | 9056 | 9075 | CCTTTACCACTAACAAGCTC | 161 | 442 |
| 1047645 | N/A | N/A | 9086 | 9105 | CAGCTCCACTGCGCACCCAA | 85 | 443 |
| 1047661 | N/A | N/A | 9300 | 9319 | AGAGCAGGGAACATAAAACT | 69 | 444 |
| 1047677 | N/A | N/A | 8400 | 8419 | AGTGCCCTTCCCACGAGGCC | 85 | 445 |
| 1047693 | N/A | N/A | 8464 | 8483 | TTGCCCTGATCCTCAGTCCC | 117 | 446 |
| 1047709 | N/A | N/A | 8547 | 8566 | CCACCTAGAAGTACCCTGGT | 75 | 447 |
| 1047725 | N/A | N/A | 8688 | 8707 | GAAAACACTCAGAAGGGCAG | 101 | 448 |
| 1047741 | N/A | N/A | 3972 | 3991 | CCCATCCCCTCCTCACTTCT | 133 | 449 |
| 1047757 | N/A | N/A | 4122 | 4141 | CTGGTCCCTCCCATCATGTT | 136 | 450 |
| 1047773 | N/A | N/A | 4273 | 4292 | GCTGCCCACAGTCACAAAGC | 126 | 451 |
| 1047789 | N/A | N/A | 4334 | 4353 | TCAACCTTCTCCGCTTCCAA | 66 | 452 |
| 1047805 | N/A | N/A | 4369 | 4388 | TTCTTCACCCCAGAATCCAA | 123 | 453 |
| 1047821 | N/A | N/A | 4508 | 4527 | TAACCACCTTTTGAAATGAA | 75 | 454 |
| 1047837 | N/A | N/A | 4657 | 4676 | CTGCTCACACAGGCGCATCC | 97 | 455 |
| 1047853 | N/A | N/A | 4709 | 4728 | TTTTGCCTTAACTCATTACT | 142 | 456 |
| 1047869 | N/A | N/A | 4813 | 4832 | TGTCACAGAGACCACCCCCA | 87 | 457 |

TABLE 7-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047885 | N/A | N/A | 4968 | 4987 | TCCACCTCCCTGACCTGTCT | 84 | 458 |
| 1047901 | N/A | N/A | 5090 | 5109 | GCCTTGCCTTACCCCTCCTT | 86 | 459 |
| 1047917 | N/A | N/A | 5284 | 5303 | TGAGCTTTCCTCCCTCTGCC | 93 | 460 |
| 1047933 | N/A | N/A | 5417 | 5436 | TAGTGTCTTTCTGTTTGTCT | 82 | 461 |
| 1047949 | N/A | N/A | 5565 | 5584 | AGTTCCCGAACCTCCTGACC | 74 | 462 |
| 1047965 | N/A | N/A | 5806 | 5825 | CTCCCAGCTTCCTCCACCCT | 101 | 463 |
| 1047981 | N/A | N/A | 5939 | 5958 | GTATCAGCTACTACTAATAA | 137 | 464 |
| 1047997 | N/A | N/A | 6080 | 6099 | TCCAACTCTACCACTTAGGA | 112 | 465 |
| 1048013 | N/A | N/A | 6152 | 6171 | CTCAGTAACCCAAAACAGAC | 79 | 466 |
| 1048029 | N/A | N/A | 6287 | 6306 | CTGGCTCCCACACTACATAT | 86 | 467 |
| 1048045 | N/A | N/A | 6354 | 6373 | TTCTTCTCTTCCTGTCCACA | 92 | 468 |
| 1048061 | N/A | N/A | 6474 | 6493 | AGTGGCTTCTGCCACTCACA | 88 | 469 |
| 1048077 | N/A | N/A | 6557 | 6576 | ACCCTGGGTTCTAATAGCCC | 104 | 470 |
| 1048093 | N/A | N/A | 7008 | 7027 | ACCTAGCACAACACCTGGTC | 77 | 471 |
| 1048109 | N/A | N/A | 7318 | 7337 | GCGCTCACCGTGCCGCGCAG | 85 | 472 |
| 1048125 | N/A | N/A | 7497 | 7516 | GAGCCCCGACCCGACTTGGG | 55 | 473 |
| 1048141 | N/A | N/A | 7943 | 7962 | GTTGAATCCATCCATCCATT | 73 | 474 |
| 1048157 | N/A | N/A | 8195 | 8214 | AGCTTTTTCCCCAGCAGCCA | 91 | 475 |
| 1048173 | N/A | N/A | 8333 | 8352 | AATGGTGATCCTGAAAGAAA | 80 | 476 |
| 1048189 | N/A | N/A | 9415 | 9434 | AGCTAAGAATCATTTCAGGG | 77 | 477 |
| 1048205 | N/A | N/A | 9584 | 9603 | CTCTCTGCCATTTATCTGTG | 67 | 478 |
| 1048221 | N/A | N/A | 9622 | 9641 | ATAGGTCCCTTTCCTGTCCC | 67 | 479 |
| 1048237 | N/A | N/A | 9796 | 9815 | CTTAGCCACCAACCAGCCAC | 123 | 480 |
| 1048253 | N/A | N/A | 10010 | 10029 | CGCACCTGTAATCCCCTTAC | 97 | 481 |
| 1048269 | N/A | N/A | 10666 | 10685 | ATCCCAATAGTGCTGCTGCC | 79 | 482 |
| 1048285 | N/A | N/A | 10755 | 10774 | CGCACCCCCCTCCCCATCAT | 109 | 483 |
| 1048301 | N/A | N/A | 10925 | 10944 | TCCTTACCTCTCCATCCCGC | 106 | 484 |
| 1048317 | N/A | N/A | 10993 | 11012 | GGCTTTCCTCCATGGCCTGG | 93 | 485 |
| 1048333 | N/A | N/A | 11092 | 11111 | GACTGAGGAAACGGAATTAC | 86 | 486 |
| 1048349 | N/A | N/A | 11278 | 11297 | ATGGAAAGCCCTCCCCATCC | 86 | 487 |
| 1048365 | N/A | N/A | 11334 | 11353 | ATACGCCAAATCCCCTCTTC | 105 | 488 |
| 1048381 | N/A | N/A | 11505 | 11524 | AAGTCCCCGACTTCCCAGGT | 79 | 489 |

TABLE 8

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047150 | 115 | 134 | 3563 | 3582 | CCCACCATCATCTCCCCTGA | 93 | 490 |
| 1047166 | 156 | 175 | 3604 | 3623 | GGCGGGTGCCAGGACCCAGA | 79 | 491 |
| 1047182 | 358 | 377 | 3806 | 3825 | AGCTGGTTCAGCTCAGCAGC | 114 | 492 |
| 1047198 | 528 | 547 | 4913 | 4932 | GGTTGGTTTCATCCTGGAGC | 19* | 493 |
| 1047214 | 619 | 638 | 5208 | 5227 | TCAATCTTCCTCTCCAGATC | 115 | 494 |
| 1047230 | 680 | 699 | N/A | N/A | GAGTTCCCGAACCTCCTCCT | 85 | 495 |
| 1047246 | 838 | 857 | N/A | N/A | AGGTCTGCAAACTTGGAGCG | 90 | 496 |
| 1047262 | 1064 | 1083 | 7636 | 7655 | CTTGAGGCTCTGCCCCTCTT | 88 | 497 |
| 1047278 | 1258 | 1277 | 10872 | 10891 | AGGTGGCCTTCTGACACAGA | 94 | 498 |
| 1047294 | 1314 | 1333 | N/A | N/A | CCTTAATGACCTCTCCATCC | 154 | 499 |
| 1047310 | 1358 | 1377 | 11647 | 11666 | GTGGGTCCTGCCTCACATCA | 88 | 500 |
| 1047326 | 1530 | 1549 | 11819 | 11838 | GGCAGGCCTGATACTGACGG | 103 | 501 |
| 1047342 | 1636 | 1655 | 11925 | 11944 | TTCCTCCTCATTCTAACGCA | 66 | 502 |
| 1047358 | 1685 | 1704 | 11974 | 11993 | TGTGGAGGGCGATGTAGTAG | 50 | 503 |
| 1047374 | 1757 | 1776 | 12046 | 12065 | GGCACAGTTCCCAGATACTC | 40 | 504 |
| 1047390 | 1813 | 1832 | 12102 | 12121 | CCTTCCCTTTCCTGTCTGAG | 81 | 505 |
| 1047406 | 2004 | 2023 | 12293 | 12312 | GTCTAGGAGAACAACCCTCT | 96 | 506 |
| 1047422 | 2112 | 2131 | 12401 | 12420 | GTGGACTGAGACACTTGAGT | 54 | 507 |
| 1047438 | 2201 | 2220 | 12490 | 12509 | CGTACACAACAGATCCCCCA | 61 | 508 |
| 1047454 | 2243 | 2262 | 12532 | 12551 | GGCAGCCCCCCTCTATCCCT | 57 | 509 |
| 1047470 | 2342 | 2361 | 12631 | 12650 | TCCCAATTGCCTCCTCCTCC | 66 | 510 |
| 1047486 | 2413 | 2432 | 12702 | 12721 | CCTTAATTCCCACAATCCAG | 147 | 511 |
| 1047502 | 2465 | 2484 | 12754 | 12773 | GATACATCCCCTTTCTCTCC | 67 | 512 |
| 1047518 | 2702 | 2721 | 12991 | 13010 | GGGCACTACCTAGAATACTG | 43 | 513 |
| 1047534 | 2843 | 2862 | 13132 | 13151 | CTGCTCACCAGTCTGCTCAG | 97 | 514 |
| 1047550 | 2878 | 2897 | 13167 | 13186 | TCCCAGTCCCATCTCTGGGC | 106 | 515 |
| 1047566 | 2933 | 2952 | 13222 | 1324 | AGGGAAGGACCCTTCTTCGG | 71 | 516 |
| 1047582 | 3047 | 3066 | 13336 | 13355 | GTCTTTATTTTTCCTCAGCG | 9 | 517 |
| 1047614 | N/A | N/A | 8850 | 8869 | GCAGCTAACCGCGAGCCGGC | 132 | 519 |
| 1047630 | N/A | N/A | 9057 | 9076 | ACCTTTACCACTAACAAGCT | 89 | 520 |
| 1047646 | N/A | N/A | 9088 | 9107 | AGCAGCTCCACTGCGCACCC | 116 | 521 |
| 1047662 | N/A | N/A | 9311 | 9330 | ATTTAACATTAAGAGCAGGG | 45 | 522 |
| 1047678 | N/A | N/A | 8401 | 8420 | CAGTGCCCTTCCCACGAGGC | 110 | 523 |
| 1047694 | N/A | N/A | 8467 | 8486 | CCTTTGCCCTGATCCTCAGT | 77 | 524 |
| 1047710 | N/A | N/A | 8549 | 8568 | CCCCACCTAGAAGTACCCTG | 99 | 525 |
| 1047726 | N/A | N/A | 8689 | 8708 | AGAAAACACTCAGAAGGGCA | 169 | 526 |

TABLE 8-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1047742 | N/A | N/A | 3973 | 3992 | CCCCATCCCCTCCTCACTTC | 100 | 527 |
| 1047758 | N/A | N/A | 4124 | 4143 | TTCTGGTCCCTCCCATCATG | 77 | 528 |
| 1047774 | N/A | N/A | 4277 | 4296 | GCTCGCTGCCCACAGTCACA | 123 | 529 |
| 1047790 | N/A | N/A | 4338 | 4357 | GACATCAACCTTCTCCGCTT | 67 | 530 |
| 1047806 | N/A | N/A | 4375 | 4394 | CTCACTTTCTTCACCCCAGA | 156 | 531 |
| 1047822 | N/A | N/A | 4510 | 4529 | GGTAACCACCTTTTGAAATG | 91 | 532 |
| 1047838 | N/A | N/A | 4659 | 4678 | TTCTGCTCACACAGGCGCAT | 148 | 533 |
| 1047854 | N/A | N/A | 4712 | 4731 | GGCTTTTGCCTTAACTCATT | 72 | 534 |
| 1047870 | N/A | N/A | 4815 | 4834 | GCTGTCACAGAGACCACCCC | 93 | 535 |
| 1047886 | N/A | N/A | 4971 | 4990 | CCCTCCACCTCCCTGACCTG | 59 | 536 |
| 1047902 | N/A | N/A | 5092 | 5111 | CAGCCTTGCCTTACCCCTCC | 70 | 537 |
| 1047918 | N/A | N/A | 5285 | 5304 | TTGAGCTTTCCTCCCTCTGC | 80 | 538 |
| 1047934 | N/A | N/A | 5429 | 5448 | TTCCGTCTCCCTTAGTGTCT | 105 | 539 |
| 1047950 | N/A | N/A | 5566 | 5585 | GAGTTCCCGAACCTCCTGAC | 70 | 540 |
| 1047966 | N/A | N/A | 5813 | 5832 | GGATATTCTCCCAGCTTCCT | 90 | 541 |
| 1047982 | N/A | N/A | 5945 | 5964 | AGAACAGTATCAGCTACTAC | 106 | 542 |
| 1047998 | N/A | N/A | 6085 | 6104 | GGAAATCCAACTCTACCACT | 106 | 543 |
| 1048014 | N/A | N/A | 6153 | 6172 | GCTCAGTAACCCAAAACAGA | 96 | 544 |
| 1048030 | N/A | N/A | 6288 | 6307 | CCTGGCTCCCACACTACATA | 116 | 545 |
| 1048046 | N/A | N/A | 6356 | 6375 | CCTTCTTCTCTTCCTGTCCA | 133 | 546 |
| 1048062 | N/A | N/A | 6486 | 6505 | TGCTCAGACACCAGTGGCTT | 109 | 547 |
| 1048078 | N/A | N/A | 6567 | 6586 | GCCTGGCCTCACCCTGGGTT | 88 | 548 |
| 1048094 | N/A | N/A | 7023 | 7042 | CTGCCAGACCTCAGCACCTA | 81 | 549 |
| 1048110 | N/A | N/A | 7322 | 7341 | GGCCGCGCTCACCGTGCCGC | 109 | 550 |
| 1048126 | N/A | N/A | 7498 | 7517 | GGAGCCCCGACCCGACTTGG | 124 | 551 |
| 1048142 | N/A | N/A | 7944 | 7963 | GGTTGAATCCATCCATCCAT | 105 | 552 |
| 1048158 | N/A | N/A | 8196 | 8215 | TAGCTTTTTCCCCAGCAGCC | 89 | 553 |
| 1048174 | N/A | N/A | 8334 | 8353 | GAATGGTGATCCTGAAAGAA | 81 | 554 |
| 1048190 | N/A | N/A | 9462 | 9481 | AGTGGTCCTAAATATTCTAG | 66 | 555 |
| 1048206 | N/A | N/A | 9585 | 9604 | TCTCTCTGCCATTTATCTGT | 91 | 556 |
| 1048222 | N/A | N/A | 9623 | 9642 | CATAGGTCCCTTTCCTGTCC | 71 | 557 |
| 1048238 | N/A | N/A | 9799 | 9818 | CAACTTAGCCACCAACCAGC | 120 | 558 |
| 1048254 | N/A | N/A | 10576 | 10595 | GGCTTTCTGAAAACCCAGCA | 72 | 559 |
| 1048270 | N/A | N/A | 10673 | 10692 | CCCCCAAATCCCAATAGTGC | 117 | 560 |
| 1048286 | N/A | N/A | 10756 | 10775 | TCGCACCCCCCTCCCCATCA | 106 | 561 |

TABLE 8-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ NO ID |
|---|---|---|---|---|---|---|---|
| 1048302 | N/A | N/A | 10926 | 10945 | CTCCTTACCTCTCCATCCCG | 120 | 562 |
| 1048318 | N/A | N/A | 10994 | 11013 | AGGCTTTCCTCCATGGCCTG | 91 | 563 |
| 1048334 | N/A | N/A | 11110 | 11129 | TAGAACAGCCTATGGAGGGA | 52 | 564 |
| 1048350 | N/A | N/A | 11300 | 11319 | GTTTCCTTTTACCAAGCTGG | 34 | 565 |
| 1048366 | N/A | N/A | 11335 | 11354 | GATACGCCAAATCCCCTCTT | 94 | 566 |
| 1048382 | N/A | N/A | 11508 | 11527 | GGGAAGTCCCCGACTTCCCA | 92 | 567 |

TABLE 9

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047151 | 116 | 135 | 3564 | 3583 | CCCCACCATCATCTCCCCTG | 89 | 568 |
| 1047167 | 173 | 192 | 3621 | 3640 | CATTCGAGCCAGGGAGAGGC | 82 | 569 |
| 1047183 | 372 | 391 | 3820 | 3839 | GCTCCTTGGCCCGCAGCTGG | 147 | 570 |
| 1047199 | 529 | 548 | 4914 | 4933 | AGGTTGGTTTCATCCTGGAG | 47* | 571 |
| 1047215 | 620 | 639 | 5209 | 5228 | CTCAATCTTCCTCTCCAGAT | 93 | 572 |
| 1047231 | 683 | 702 | 5569 | 5588 | CTGGAGTTCCCGAACCTCCT | 113 | 573 |
| 1047247 | 943 | 962 | 7300 | 7319 | AGAGACTCCAGGTCGCAGGT | 104 | 574 |
| 1047263 | 1098 | 1117 | 7670 | 7689 | CCTGGTACTOCTGCAAGTGG | 139 | 575 |
| 1047279 | 1260 | 1279 | 10874 | 10893 | TGAGGTGGCCTTCTGACACA | 106 | 576 |
| 1047295 | 1319 | 1338 | N/A | N/A | GGACTCCTTAATGACCTCTC | 77 | 577 |
| 1047311 | 1370 | 1389 | 11659 | 11678 | AGAGGCCACCAGGTGGGTCC | 88 | 578 |
| 1047327 | 1531 | 1550 | 11820 | 11839 | TGGCAGGCCTGATACTGACG | 71 | 579 |
| 1047343 | 1637 | 1656 | 11926 | 11945 | CTTCCTCCTCATTCTAACGC | 68 | 580 |
| 1047359 | 1714 | 1733 | 12003 | 12022 | ACAGTTTCCATAACAACAGG | 137 | 581 |
| 1047375 | 1760 | 1779 | 12049 | 12068 | AAAGGCACAGTTCCCAGATA | 106 | 582 |
| 1047391 | 1814 | 1833 | 12103 | 12122 | GCCTTCCCTTTOCTGTCTGA | 34 | 583 |
| 1047407 | 2005 | 2024 | 12294 | 12313 | AGTCTAGGAGAACAACCCTC | 113 | 584 |
| 1047423 | 2138 | 2157 | 12427 | 12446 | GATGGCATCCCTGGATGGCA | 113 | 585 |
| 1047439 | 2219 | 2238 | 12508 | 12527 | GCACCTCATCCCTCTCCACG | 75 | 586 |
| 1047455 | 2244 | 2263 | 12533 | 12552 | AGGCAGCCCCCCTCTATCCC | 77 | 587 |
| 1047471 | 2343 | 2362 | 12632 | 12651 | ATCCCAATTGCCTCCTCCTC | 96 | 588 |
| 1047487 | 2414 | 2433 | 12703 | 12722 | TCCTTAATTCCCACAATCCA | 105 | 589 |

TABLE 9-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047503 | 2466 | 2485 | 12755 | 12774 | GGATACATCCCCTTTCTCTC | 48 | 590 |
| 1047519 | 2727 | 2746 | 13016 | 13035 | GCCTCAGTTTTACAATTGTA | 90 | 591 |
| 1047535 | 2844 | 2863 | 13133 | 13152 | TCTGCTCACCAGTCTGCTCA | 92 | 592 |
| 1047551 | 2880 | 2899 | 13169 | 13188 | CCTCCCAGTCCCATCTCTGG | 90 | 593 |
| 1047567 | 2937 | 2956 | 13226 | 13245 | GGAGAGGGAAGGACCCTTCT | 105 | 594 |
| 1047583 | 3048 | 3067 | 13337 | 13356 | TGTCTTTATTTTTCCTCAGC | 10 | 595 |
| 1047615 | N/A | N/A | 8851 | 8870 | GGCAGCTAACCGCGAGCCGG | 92 | 597 |
| 1047631 | N/A | N/A | 9058 | 9077 | CACCTTTACCACTAACAAGC | 105 | 598 |
| 1047647 | N/A | N/A | 9089 | 9108 | GAGCAGCTCCACTGCGCACC | 87 | 599 |
| 1047663 | N/A | N/A | 9312 | 9331 | TATTTAACATTAAGAGCAGG | 106 | 600 |
| 1047679 | N/A | N/A | 8402 | 8421 | CCAGTGCCCTTCCCACGAGG | 78 | 601 |
| 1047695 | N/A | N/A | 8469 | 8488 | TCCCTTTGCCCTGATCCTCA | 74 | 602 |
| 1047711 | N/A | N/A | 8551 | 8570 | AGCCCCACCTAGAAGTACCC | 86 | 603 |
| 1047727 | N/A | N/A | 8690 | 8709 | CAGAAAACACTCAGAAGGGC | 93 | 604 |
| 1047743 | N/A | N/A | 3974 | 3993 | TCCCCATCCCCTCCTCACTT | 92 | 605 |
| 1047759 | N/A | N/A | 4126 | 4145 | GTTTCTGGTCCCTCCCATCA | 98 | 606 |
| 1047775 | N/A | N/A | 4278 | 4297 | AGCTCGCTGCCCACAGTCAC | 170 | 607 |
| 1047791 | N/A | N/A | 4339 | 4358 | GGACATCAACCTTCTCCGCT | 98 | 608 |
| 1047807 | N/A | N/A | 4376 | 4395 | CCTCACTTTCTTCACCCCAG | 104 | 609 |
| 1047823 | N/A | N/A | 4512 | 4531 | CAGGTAACCACCTTTTGAAA | 82 | 610 |
| 1047839 | N/A | N/A | 4661 | 4680 | GCTTCTGCTCACACAGGCGC | 96 | 611 |
| 1047855 | N/A | N/A | 4713 | 4732 | GGGCTTTTGCCTTAACTCAT | 89 | 612 |
| 1047871 | N/A | N/A | 4833 | 4852 | TCAGTCTCCCTTGAGGCAGC | 87 | 613 |
| 1047887 | N/A | N/A | 4972 | 4991 | CCCCTCCACCTCCCTGACCT | 109 | 614 |
| 1047903 | N/A | N/A | 5093 | 5112 | TCAGCCTTGCCTTACCCCTC | 96 | 615 |
| 1047919 | N/A | N/A | 5286 | 5305 | GTTGAGCTTTCCTCCCTCTG | 82 | 616 |
| 1047935 | N/A | N/A | 5434 | 5453 | TCTCTTTCCGTCTCCCTTAG | 83 | 617 |
| 1047951 | N/A | N/A | 5724 | 5743 | GGCAGGGCTACCTTGGAGCG | 98 | 618 |
| 1047967 | N/A | N/A | 5814 | 5833 | AGGATATTCTCCCAGCTTCC | 74 | 619 |
| 1047983 | N/A | N/A | 5946 | 5965 | CAGAACAGTATCAGCTACTA | 76 | 620 |
| 1047999 | N/A | N/A | 6086 | 6105 | TGGAAATCCAACTCTACCAC | 122 | 621 |
| 1048015 | N/A | N/A | 6154 | 6173 | GGCTCAGTAACCCAAAACAG | 82 | 622 |
| 1048031 | N/A | N/A | 6290 | 6309 | TTCCTGGCTCCCACACTACA | 106 | 623 |
| 1048047 | N/A | N/A | 6362 | 6381 | GCCCTCCCTTCTTCTCTTCC | 84 | 624 |
| 1048063 | N/A | N/A | 6487 | 6506 | CTGCTCAGACACCAGTGGCT | 111 | 625 |

TABLE 9-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048079 | N/A | N/A | 6569 | 6588 | TCGCCTGGCCTCACCCTGGG | 101 | 626 |
| 1048095 | N/A | N/A | 7024 | 7043 | GCTGCCAGACCTCAGCACCT | 192 | 627 |
| 1048111 | N/A | N/A | 7328 | 7347 | TGCCCTGGCCGCGCTCACCG | 82 | 628 |
| 1048127 | N/A | N/A | 7502 | 7521 | CCGCGGAGCCCCGACCCGAC | 90 | 629 |
| 1048143 | N/A | N/A | 7945 | 7964 | TGGTTGAATCCATOCATCCA | 117 | 630 |
| 1048159 | N/A | N/A | 8197 | 8216 | CTAGCTTTTTCCCCAGCAGC | 100 | 631 |
| 1048175 | N/A | N/A | 9316 | 9335 | CTAATATTTAACATTAAGAG | 128 | 632 |
| 1048191 | N/A | N/A | 9463 | 9482 | TAGTGGTCCTAAATATTCTA | 106 | 633 |
| 1048207 | N/A | N/A | 9586 | 9605 | TTCTCTCTGCCATTTATCTG | 70 | 634 |
| 1048223 | N/A | N/A | 9625 | 9644 | CACATAGGTCCCTTTCCTGT | 74 | 635 |
| 1048239 | N/A | N/A | 9800 | 9819 | CCAACTTAGCCACCAACCAG | 96 | 636 |
| 1048255 | N/A | N/A | 10577 | 10596 | TGGCTTTCTGAAAACCCAGC | 83 | 637 |
| 1048271 | N/A | N/A | 10674 | 10693 | GCCCCCAAATOCCAATAGTG | 116 | 638 |
| 1048287 | N/A | N/A | 10757 | 10776 | ATCGCACCCCCCTCCCCATC | 142 | 639 |
| 1048303 | N/A | N/A | 10928 | 10947 | CCCTCCTTACCTCTCCATCC | 117 | 640 |
| 1048319 | N/A | N/A | 10996 | 11015 | CCAGGCTTTCCTCCATGGCC | 88 | 641 |
| 1048335 | N/A | N/A | 11111 | 11130 | TTAGAACAGCCTATGGAGGG | 115 | 642 |
| 1048351 | N/A | N/A | 11301 | 11320 | AGTTTCCTTTTACCAAGCTG | 54 | 643 |
| 1048367 | N/A | N/A | 11337 | 11356 | CGGATACGCCAAATCCCCTC | 101 | 644 |
| 1048383 | N/A | N/A | 11539 | 11558 | CAGGTCCACCACCACGAGGC | 138 | 645 |

TABLE 10

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047152 | 117 | 136 | 3565 | 3584 | CCCCCACCATCATCTCCCCT | 104 | 646 |
| 1047168 | 175 | 194 | 3623 | 3642 | GGCATTCGAGCCAGGGAGAG | 90 | 647 |
| 1047184 | 435 | 454 | 3883 | 3902 | GTTGATCGAGCCGCAGCCGC | 104 | 648 |
| 1047200 | 530 | 549 | 4915 | 4934 | CAGGTTGGTTTCATCCTGGA | 56* | 649 |
| 1047216 | 621 | 640 | 5210 | 5229 | ACTCAATCTTCCTCTCCAGA | 95 | 650 |
| 1047232 | 684 | 703 | 5570 | 5589 | CCTGGAGTTCCCGAACCTCC | 126 | 651 |
| 1047248 | 946 | 965 | 7303 | 7322 | CGCAGAGACTCCAGGTCGCA | 104 | 652 |
| 1047264 | 1100 | 1119 | 7672 | 7691 | GTCCTGGTACTCCTGCAAGT | 89 | 653 |

TABLE 10-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047280 | 1273 | 1292 | 10887 | 10906 | ACGATGTTCCTCTTGAGGTG | 96 | 654 |
| 1047296 | 1320 | 1339 | N/A | N/A | TGGACTOCTTAATGACCTCT | 101 | 655 |
| 1047312 | 1372 | 1391 | 11661 | 11680 | GCAGAGGCCACCAGGTGGGT | 64 | 656 |
| 1047328 | 1580 | 1599 | 11869 | 11888 | GGTGAGTTTCTTGTTAGTTG | 29 | 657 |
| 1047344 | 1638 | 1657 | 11927 | 11946 | CCTTCCTCCTCATTCTAACG | 73 | 658 |
| 1047360 | 1715 | 1734 | 12004 | 12023 | AACAGTTTCCATAACAACAG | 115 | 659 |
| 1047376 | 1761 | 1780 | 12050 | 12069 | CAAAGGCACAGTTCCCAGAT | 94 | 660 |
| 1047392 | 1815 | 1834 | 12104 | 12123 | GGCCTTCCCTTTCCTGTCTG | 104 | 661 |
| 1047408 | 2021 | 2040 | 12310 | 12329 | TAGACTGATCAGGGTCAGTC | 125 | 662 |
| 1047424 | 2148 | 2167 | 12437 | 12456 | CGTGCCCACAGATGGCATCC | 87 | 663 |
| 1047440 | 2222 | 2241 | 12511 | 12530 | CCAGCACCTCATCCCTCTCC | 111 | 664 |
| 1047456 | 2246 | 2265 | 12535 | 12554 | CCAGGCAGCCCCCCTCTATC | 87 | 665 |
| 1047472 | 2345 | 2364 | 12634 | 12653 | CCATCCCAATTGCCTCCTCC | 76 | 666 |
| 1047488 | 2417 | 2436 | 12706 | 12725 | ACTTCCTTAATTCCCACAAT | 103 | 667 |
| 1047504 | 2468 | 2487 | 12757 | 12776 | ATGGATACATCCCCTTTCTC | 73 | 668 |
| 1047520 | 2728 | 2747 | 13017 | 13036 | TGCCTCAGTTTTACAATTGT | 109 | 669 |
| 1047536 | 2845 | 2864 | 13134 | 13153 | GTCTGCTCACCAGTCTGCTC | 110 | 670 |
| 1047552 | 2883 | 2902 | 13172 | 13191 | GGCCCTOCCAGTCCCATCTC | 85 | 671 |
| 1047568 | 2956 | 2975 | 13245 | 13264 | AAAGGACACCAAGTCTTGGG | 69 | 672 |
| 1047584 | 3049 | 3068 | 13338 | 13357 | TTGTCTTTATTTTTCCTCAG | 11 | 673 |
| 1047616 | N/A | N/A | 8852 | 8871 | AGGCAGCTAACCGCGAGCCG | 94 | 675 |
| 1047632 | N/A | V/A | 9059 | 9078 | CCACCTTTACCACTAACAAG | 89 | 676 |
| 1047648 | N/A | N/A | 9101 | 9120 | TCAGAGGCCCCAGAGCAGCT | 86 | 677 |
| 1047664 | N/A | N/A | 9314 | 9333 | AATATTTAACATTAAGAGCA | 105 | 678 |
| 1047680 | N/A | N/A | 8404 | 8423 | CTCCAGTGCCCTTCCCACGA | 86 | 679 |
| 1047696 | N/A | N/A | 8471 | 8490 | GATCCCTTTGCCCTGATCCT | 76 | 680 |
| 1047712 | N/A | N/A | 8554 | 8573 | GCAAGCCCCACCTAGAAGTA | 76 | 681 |
| 1047728 | N/A | N/A | 8691 | 8710 | ACAGAAAACACTCAGAAGGG | 92 | 682 |
| 1047744 | N/A | N/A | 3984 | 4003 | AGGCCCCCCTTCCCCATCCC | 79 | 683 |
| 1047760 | N/A | N/A | 4138 | 4157 | GGCCCTGGGCCTGTTTCTGG | 86 | 684 |
| 1047776 | N/A | N/A | 4279 | 4298 | GAGCTCGCTGCCCACAGTCA | 119 | 685 |
| 1047792 | N/A | N/A | 4340 | 4359 | TGGACATCAACCTTCTOCGC | 102 | 686 |
| 1047808 | N/A | N/A | 4377 | 4396 | CCCTCACTTTCTTCACCCCA | 71 | 687 |
| 1047824 | N/A | N/A | 4513 | 4532 | CCAGGTAACCACCTTTTGAA | 104 | 688 |
| 1047840 | N/A | N/A | 4686 | 4705 | GTGCCTTATCAGGGTTGGTG | 64 | 689 |

TABLE 10-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047856 | N/A | N/A | 4714 | 4733 | TGGGCTTTTGCCTTAACTCA | 79 | 690 |
| 1047872 | N/A | N/A | 4835 | 4854 | CCTCAGTCTCCCTTGAGGCA | 104 | 691 |
| 1047888 | N/A | N/A | 4976 | 4995 | CCCTCCCCTCCACCTCCCTG | 79 | 692 |
| 1047904 | N/A | N/A | 5094 | 5113 | CTCAGCCTTGCCTTACCCCT | 121 | 693 |
| 1047920 | N/A | N/A | 5313 | 5332 | TCTCCCTCTCTCAGTTGCAA | 80 | 694 |
| 1047936 | N/A | N/A | 5436 | 5455 | TGTCTCTTTCCGTCTCCCTT | 76 | 695 |
| 1047952 | N/A | N/A | 5738 | 5757 | CAGGCTGGCCCACAGGCAGG | 96 | 696 |
| 1047968 | N/A | V/A | 5815 | 5834 | GAGGATATTCTCCCAGCTTC | 83 | 697 |
| 1047984 | N/A | N/A | 5993 | 6012 | CACCTACTTCATAGTAAGGT | 144 | 698 |
| 1048000 | N/A | N/A | 6088 | 6107 | GTTGGAAATCCAACTCTACC | 75 | 699 |
| 1048016 | N/A | N/A | 6155 | 6174 | AGGCTCAGTAACCCAAAACA | 97 | 700 |
| 1048032 | N/A | N/A | 6298 | 6317 | CAGTGTCTTTCCTGGCTCCC | 72 | 701 |
| 1048048 | N/A | N/A | 6363 | 6382 | GGCCCTCCCTTCTTCTCTTC | 106 | 702 |
| 1048064 | N/A | N/A | 6491 | 6510 | CACCCTGCTCAGACACCAGT | 112 | 703 |
| 1048080 | N/A | N/A | 6570 | 6589 | CTCGCCTGGCCTCACCCTGG | 80 | 704 |
| 1048096 | N/A | N/A | 7028 | 7047 | GCGGGCTGCCAGACCTCAGC | 82 | 705 |
| 1048112 | N/A | V/A | 7335 | 7354 | CCCGTCCTGCCCTGGCCGCG | 92 | 706 |
| 1048128 | N/A | N/A | 7833 | 7852 | AAAAGACTCAGTCCCTGAA | 103 | 707 |
| 1048144 | N/A | N/A | 7946 | 7965 | TTGGTTGAATCCATCCATCC | 68 | 708 |
| 1048160 | N/A | N/A | 8198 | 8217 | CCTAGCTTTTTCCCCAGCAG | 71 | 709 |
| 1048176 | N/A | N/A | 9317 | 9336 | ACTAATATTTAACATTAAGA | 69 | 710 |
| 1048192 | N/A | N/A | 9465 | 9484 | TCTAGTGGTCCTAAATATTC | 108 | 711 |
| 1048208 | N/A | N/A | 9593 | 9612 | TTCCTACTTCTCTCTGCCAT | 80 | 712 |
| 1048224 | N/A | N/A | 9633 | 9652 | GCTCAATACACATAGGTCCC | 82 | 713 |
| 1048240 | N/A | N/A | 9801 | 9820 | CCCAACTTAGCCACCAACCA | 120 | 714 |
| 1048256 | N/A | N/A | 10578 | 10597 | CTGGCTTTCTGAAAACCCAG | 119 | 715 |
| 1048272 | N/A | N/A | 0675 | 10694 | AGCCCCCAAATCCCAATAGT | 116 | 716 |
| 1048288 | N/A | N/A | 10759 | 10778 | CCATCGCACCCCCCTCCCCA | 88 | 717 |
| 1048304 | N/A | N/A | 10929 | 10948 | TCCCTCCTTACCTCTCCATC | 73 | 718 |
| 1048320 | N/A | N/A | 10997 | 11016 | CCCAGGCTTTCCTCCATGGC | 113 | 719 |
| 1048336 | N/A | V/A | 11112 | 11131 | CTTAGAACAGCCTATGGAGG | 74 | 720 |
| 1048352 | N/A | N/A | 11302 | 11321 | TAGTTTCCTTTTACCAAGCT | 97 | 721 |
| 1048368 | N/A | N/A | 11338 | 11357 | GCGGATACGCCAAATCCCCT | 74 | 722 |
| 1048384 | N/A | N/A | 11541 | 11560 | CCCAGGTCCACCACCACGAG | 105 | 723 |

TABLE 11

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047153 | 119 | 138 | 356 | 3586 | GCCCCCCACCATCATCTCCC | 88 | 724 |
| 1047169 | 210 | 229 | 3658 | 3677 | CCAGGGAGAAATCCACCCGG | 81 | 725 |
| 1047185 | 440 | 459 | 3888 | 3907 | GGTGAGTTGATCGAGCCGCA | 70 | 726 |
| 1047201 | 539 | 558 | 4924 | 4943 | TTCCAGCCTCAGGTTGGTTT | 29* | 727 |
| 1047217 | 627 | 646 | 5216 | 5235 | CCAGCGACTCAATCTTCCTC | 99 | 728 |
| 1047233 | 703 | 722 | 5589 | 5608 | TGCTGTCGGGCCAGCTGCTC | 118 | 729 |
| 1047249 | 990 | 1009 | 7562 | 7581 | CCTCCTGCTCGCGCATCTGC | 93 | 730 |
| 1047265 | 1101 | 1120 | 7673 | 7692 | GGTCCTGGTACTCCTGCAAG | 129 | 731 |
| 1047281 | 1274 | 1293 | 10888 | 10907 | CACGATGTTCCTCTTGAGGT | 104 | 732 |
| 1047297 | 1321 | 1340 | N/A | N/A | TTGGACTCCTTAATGACCTC | 110 | 733 |
| 1047313 | 1393 | 1412 | 11682 | 11701 | TCGGGCCCCTCATGAGACGG | 99 | 734 |
| 1047329 | 1605 | 1624 | 11894 | 11913 | ATGCCCCTCCAGACTGCCCC | 109 | 735 |
| 1047345 | 1640 | 1659 | 11929 | 11948 | CTCCTTCCTCCTCATTCTAA | 89 | 736 |
| 1047361 | 1716 | 1735 | 12005 | 12024 | CAACAGTTTCCATAACAACA | 62 | 737 |
| 1047377 | 1770 | 1789 | 12059 | 12078 | GAGGAAACTCAAAGGCACAG | 82 | 738 |
| 1047393 | 1816 | 1835 | 12105 | 12124 | GGGCCTTCCCTTTCCTGTCT | 64 | 739 |
| 1047409 | 2024 | 2043 | 12313 | 12332 | TCTTAGACTGATCAGGGTCA | 124 | 740 |
| 1047425 | 2166 | 2185 | 12455 | 12474 | GCTCCCACCTGCCCACAGCG | 79 | 741 |
| 1047441 | 2224 | 2243 | 12513 | 12532 | TCCCAGCACCTCATCCCTCT | 109 | 742 |
| 1047457 | 2247 | 2266 | 12536 | 12555 | GCCAGGCAGCCCCCCTCTAT | 100 | 743 |
| 1047473 | 2369 | 2388 | 12658 | 12677 | CAACCCCTACTTGTATGCCT | 73 | 744 |
| 1047489 | 2429 | 2448 | 12718 | 12737 | AGAGGATGAGTCACTTCCTT | 116 | 745 |
| 1047505 | 2469 | 2488 | 12758 | 12777 | CATGGATACATCCCCTTTCT | 83 | 746 |
| 1047521 | 2748 | 2767 | 13037 | 13056 | CAGTGTCTTCACTTTGCTCG | 69 | 747 |
| 1047537 | 2846 | 2865 | 13135 | 13154 | AGTCTGCTCACCAGTCTGCT | 103 | 748 |
| 1047553 | 2884 | 2903 | 13173 | 13192 | GGGCCCTCCCAGTCCCATCT | 105 | 749 |
| 1047569 | 2957 | 2976 | 13246 | 13265 | GAAAGGACACCAAGTCTTGG | 117 | 750 |
| 1047585 | 3050 | 3069 | 13339 | 13358 | TTTGTCTTTATTTTTCCTCA | 20 | 751 |
| 1047601 | N/A | N/A | 8751 | 8770 | GATTTTCCCCGTCTTTGGTG | 38 | 752 |
| 1047617 | N/A | N/A | 8901 | 8920 | GTGAGGCTCACTOCCTGTCA | 95 | 753 |
| 1047633 | N/A | N/A | 9060 | 9079 | ACCACCTTTACCACTAACAA | 108 | 754 |
| 1047649 | N/A | N/A | 9107 | 9126 | GCTTGCTCAGAGGCCCCAGA | 59 | 755 |
| 1047665 | N/A | N/A | 9315 | 9334 | TAATATTTAACATTAAGAGC | 135 | 756 |
| 1047681 | N/A | N/A | 8406 | 8425 | GACTCCAGTGCCCTTCCCAC | 109 | 757 |
| 1047697 | N/A | N/A | 8473 | 8492 | TGGATCCCTTTGCCCTGATC | 90 | 758 |

TABLE 11-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047713 | N/A | N/A | 8557 | 8576 | GCTGCAAGCCCCACCTAGAA | 69 | 759 |
| 1047729 | N/A | N/A | 8692 | 8711 | AACAGAAAACACTCAGAAGG | 97 | 760 |
| 1047745 | N/A | N/A | 3985 | 4004 | AAGGCCCCCCTTCCCCATCC | 109 | 761 |
| 1047761 | N/A | N/A | 4158 | 4177 | TGCGGGCATCAGATCCCCGG | 138 | 762 |
| 1047777 | N/A | N/A | 4313 | 4332 | TCCTCCTTTATATGGACACA | 111 | 763 |
| 1047793 | N/A | N/A | 4341 | 4360 | ATGGACATCAACCTTCTCCG | 74 | 764 |
| 1047809 | N/A | N/A | 4378 | 4397 | TCCCTCACTTTCTTCACCCC | 100 | 765 |
| 1047825 | N/A | N/A | 4514 | 4533 | CCCAGGTAACCACCTTTTGA | 92 | 766 |
| 1047841 | N/A | N/A | 4689 | 4708 | AAGGTGCCTTATCAGGGTTG | 74 | 767 |
| 1047857 | N/A | N/A | 4716 | 4735 | TGTGGGCTTTTGCCTTAACT | 103 | 768 |
| 1047873 | N/A | N/A | 4841 | 4860 | TACCTGCCTCAGTCTCCCTT | 130 | 769 |
| 1047889 | N/A | N/A | 4998 | 5017 | AATCCTTTCCTCCCTCCCCT | 129 | 770 |
| 1047905 | N/A | N/A | 5103 | 5122 | TCCCCATTCCTCAGCCTTGC | 112 | 771 |
| 1047921 | N/A | N/A | 5317 | 5336 | TGTCTCTCCCTCTCTCAGTT | 88 | 772 |
| 1047937 | N/A | N/A | 5438 | 5457 | CTTGTCTCTTTCCGTCTCCC | 105 | 773 |
| 1047953 | N/A | N/A | 5739 | 5758 | GCAGGCTGGCCCACAGGCAG | 83 | 774 |
| 1047969 | N/A | N/A | 5816 | 5835 | AGAGGATATTCTCCCAGCTT | 80 | 775 |
| 1047985 | N/A | N/A | 5994 | 6013 | GCACCTACTTCATAGTAAGG | 65 | 776 |
| 1048001 | N/A | N/A | 6089 | 6108 | AGTTGGAAATCCAACTCTAC | 88 | 777 |
| 1048017 | N/A | N/A | 6157 | 6176 | AGAGGCTCAGTAACCCAAAA | 90 | 778 |
| 1048033 | N/A | N/A | 6306 | 6325 | CCCCTCTACAGTGTCTTTCC | 101 | 779 |
| 1048049 | N/A | N/A | 6364 | 6383 | TGGCCCTCCCTTCTTCTCTT | 89 | 780 |
| 1048065 | N/A | N/A | 6497 | 6516 | GGCCCTCACCCTGCTCAGAC | 143 | 781 |
| 104808 | N/A | N/A | 6571 | 6590 | CCTCGCCTGGCCTCACCCTG | 116 | 782 |
| 1048097 | N/A | N/A | 7056 | 7075 | ACTGTGACCCATGGATGCGG | 98 | 783 |
| 1048113 | N/A | N/A | 7343 | 7362 | CGCCCGTCCCCGTCCTGCCC | 92 | 784 |
| 1048129 | N/A | N/A | 7835 | 7854 | TGAAAAAGACTCAGTCCCTG | 103 | 785 |
| 1048145 | N/A | N/A | 7947 | 7966 | ATTGGTTGAATCCATCCATC | 106 | 786 |
| 1048161 | N/A | N/A | 8199 | 8218 | TCCTAGCTTTTTCCCCAGCA | 92 | 787 |
| 1048177 | N/A | N/A | 9318 | 9337 | CACTAATATTTAACATTAAG | 120 | 788 |
| 1048193 | N/A | N/A | 9475 | 9494 | GACATGCATATCTAGTGGTC | 64 | 789 |
| 1048209 | N/A | N/A | 9595 | 9614 | CTTTCCTACTTCTCTCTGCC | 107 | 790 |
| 1048225 | N/A | N/A | 9634 | 9653 | TGCTCAATACACATAGGTCC | 95 | 791 |
| 1048241 | N/A | N/A | 9806 | 9825 | GAAGTCCCAACTTAGCCACC | 101 | 792 |
| 1048257 | N/A | N/A | 10579 | 10598 | CCTGGCTTTCTGAAAACCCA | 70 | 793 |

TABLE 11-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048273 | N/A | N/A | 10683 | 10702 | GGCTGGAGAGCCCCCAAATC | 144 | 794 |
| 1048289 | N/A | N/A | 10766 | 10785 | GGCTTCCCCATCGCACCCCC | 117 | 795 |
| 1048305 | N/A | N/A | 10930 | 10949 | ATCCCTCCTTACCTCTCCAT | 106 | 796 |
| 1048321 | N/A | N/A | 10998 | 11017 | CCCCAGGCTTTCCTCCATGG | 81 | 797 |
| 1048337 | N/A | N/A | 11113 | 11132 | CCTTAGAACAGCCTATGGAG | 162 | 798 |
| 1048353 | N/A | N/A | 11305 | 11324 | TGGTAGTTTCCTTTTACCAA | 89 | 799 |
| 1048369 | N/A | N/A | 11339 | 11358 | GGCGGATACGCCAAATCCCC | 93 | 800 |
| 1048385 | N/A | N/A | 11547 | 11566 | ACAGACCCCAGGTOCACCAC | 104 | 801 |

TABLE 12

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047154 | 120 | 139 | 3568 | 3587 | GGCCCCCCACCATCATCTCC | 97 | 802 |
| 1047170 | 226 | 245 | 3674 | 3693 | GCATTGAGTGCCCCAGCCAG | 128 | 803 |
| 1047186 | 471 | 490 | 3919 | 3938 | CCCTCTCAACCTCCAGCCGG | 3* | 804 |
| 1047202 | 541 | 560 | 4926 | 4945 | GCTTCCAGCCTCAGGTTGGT | 18* | 805 |
| 1047218 | 628 | 647 | 5217 | 5236 | TCCAGCGACTCAATCTTCCT | 100 | 806 |
| 1047234 | 723 | 742 | 5609 | 5628 | CGTCAAGCTCCACATGGACC | 144 | 807 |
| 1047250 | 1017 | 1036 | 7589 | 7608 | AACTGGCCGCCTCCCGCACG | 127 | 808 |
| 1047266 | 1206 | 1225 | 8355 | 8374 | GGTTGGAGAAGGTCTGCACG | 77 | 809 |
| 1047282 | 1275 | 1294 | 10889 | 10908 | CCACGATGTTCCTCTTGAGG | 157 | 810 |
| 1047298 | 1322 | 1341 | 11611 | 11630 | CTTGGACTCCTTAATGACCT | 64 | 811 |
| 1047314 | 1395 | 1414 | 11684 | 11703 | GCTCGGGCCCCTCATGAGAC | 100 | 812 |
| 1047330 | 1606 | 1625 | 11895 | 11914 | CATGCCCCTCCAGACTGCCC | 106 | 813 |
| 1047346 | 1657 | 1676 | 11946 | 11965 | CGCCCTCCTCCCCTTCTCTC | 79 | 814 |
| 1047362 | 1718 | 1737 | 12007 | 12026 | GGCAACAGTTTCCATAACAA | 31 | 815 |
| 1047378 | 1771 | 1790 | 12060 | 12079 | TGAGGAAACTCAAAGGCACA | 79 | 816 |
| 1047394 | 1835 | 1854 | 12124 | 12143 | CAGGGCTACCTTGTCTGTGG | 40 | 817 |
| 1047410 | 2025 | 2044 | 12314 | 12333 | ATCTTAGACTGATCAGGGTC | 67 | 818 |
| 1047426 | 2167 | 2186 | 12456 | 12475 | AGCTCCCACCTGCCCACAGC | 94 | 819 |
| 1047442 | 2226 | 2245 | 12515 | 12534 | CCTCCCAGCACCTCATCCCT | 97 | 820 |
| 1047458 | 2268 | 2287 | 12557 | 12576 | TCTCTGTACCCACAGCTGGG | 84 | 821 |

TABLE 12-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047474 | 2371 | 2390 | 12660 | 12679 | CACAACCCCTACTTGTATGC | 61 | 822 |
| 1047490 | 2442 | 2461 | 12731 | 12750 | TTCAGCATCTTCAAGAGGAT | 92 | 823 |
| 1047506 | 2470 | 2489 | 12759 | 12778 | CCATGGATACATCCCCTTTC | 151 | 824 |
| 1047522 | 2749 | 2768 | 13038 | 13057 | CCAGTGTCTTCACTTTGCTC | 44 | 825 |
| 1047538 | 2847 | 2866 | 13136 | 13155 | CAGTCTGCTCACCAGTCTGC | 103 | 826 |
| 1047554 | 2885 | 2904 | 13174 | 13193 | TGGGCCCTCCCAGTCCCATC | 172 | 827 |
| 1047570 | 2958 | 2977 | 13247 | 13266 | GGAAAGGACACCAAGTCTTG | 90 | 828 |
| 1047586 | 3051 | 3070 | 13340 | 13359 | ATTTGTCTTTATTTTTCCTC | 32 | 829 |
| 1047602 | N/A | N/A | 8754 | 8773 | TGTGATTTTCCCCGTCTTTG | 54 | 830 |
| 1047618 | N/A | N/A | 8902 | 8921 | GGTGAGGCTCACTCCCTGTC | 65 | 831 |
| 1047634 | N/A | N/A | 9061 | 9080 | CACCACCTTTACCACTAACA | 88 | 832 |
| 1047650 | N/A | N/A | 9109 | 9128 | CTGCTTGCTCAGAGGCCCCA | 115 | 833 |
| 1047666 | N/A | N/A | 8372 | 8391 | CTGACCTCGAATCTGCAGGT | 84 | 834 |
| 1047682 | N/A | N/A | 8412 | 8431 | GGGCAGGACTCCAGTGCCCT | 118 | 835 |
| 1047698 | N/A | N/A | 8474 | 8493 | CTGGATCCCTTTGCCCTGAT | 100 | 836 |
| 1047714 | N/A | N/A | 8626 | 8645 | CACCCAGITCTGCTGTOGAA | 94 | 837 |
| 1047730 | N/A | N/A | 8696 | 8715 | CAAAAACAGAAAACACTCAG | 160 | 838 |
| 1047746 | N/A | N/A | 3987 | 4006 | ACAAGGCCCCCCTTCCCCAT | 57 | 839 |
| 1047762 | N/A | N/A | 4215 | 4234 | CACTGCTTTCCCCAGTAGGG | 48 | 840 |
| 1047778 | N/A | N/A | 4314 | 4333 | CTCCTCCTTTATATGGACAC | 96 | 841 |
| 1047794 | N/A | N/A | 4345 | 4364 | CCTCATGGACATCAACCTTC | 92 | 842 |
| 1047810 | N/A | N/A | 4379 | 4398 | TTCCCTCACTTTCTTCACCC | 102 | 843 |
| 1047826 | N/A | N/A | 4515 | 4534 | TCCCAGGTAACCACCTTTTG | 76 | 844 |
| 1047842 | N/A | N/A | 4691 | 4710 | CTAAGGTGCCTTATCAGGGT | 78 | 845 |
| 1047858 | N/A | N/A | 4794 | 4813 | ACCCAGGACCAGTAGAGCAG | 84 | 846 |
| 1047874 | N/A | N/A | 4843 | 4862 | AATACCTGCCTCAGTCTCCC | 106 | 847 |
| 1047890 | N/A | N/A | 4999 | 5018 | CAATCCTTTCCTCCCTCCCC | 109 | 848 |
| 1047906 | N/A | N/A | 5104 | 5123 | CTCCCCATTCCTCAGCCTTG | 90 | 849 |
| 1047922 | N/A | N/A | 5334 | 5353 | CTCAGCTTCTCTGTCTCTGT | 123 | 850 |
| 1047938 | N/A | N/A | 5465 | 5484 | CCCCTCGGCCAGGAGTTCGA | 123 | 851 |
| 1047954 | N/A | N/A | 5781 | 5800 | CCCCATTCTCTTGTACAGAG | 98 | 852 |
| 1047970 | N/A | N/A | 5817 | 5836 | GAGAGGATATTCTCCCAGCT | 151 | 853 |
| 1047986 | N/A | N/A | 6001 | 6020 | AAGAACAGCACCTACTTCAT | 85 | 854 |
| 1048002 | N/A | N/A | 6090 | 6109 | GAGTTGGAAATCCAACTCTA | 97 | 855 |
| 1048018 | N/A | N/A | 6159 | 6178 | GTAGAGGCTCAGTAACCCAA | 51 | 856 |

TABLE 12-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048034 | N/A | N/A | 6310 | 6329 | ATGCCCCCTCTACAGTGTCT | 71 | 857 |
| 1048050 | N/A | N/A | 6366 | 6385 | AATGGCCCTCCCTTCTTCTC | 177 | 858 |
| 1048066 | N/A | N/A | 6503 | 6522 | CCATCGGGCCCTCACCCTGC | 110 | 859 |
| 1048082 | N/A | N/A | 6951 | 6970 | ACCTTCCACACTGACAGCTG | 169 | 860 |
| 1048098 | N/A | N/A | 7058 | 7077 | CAACTGTGACCCATGGATGC | 78 | 861 |
| 1048114 | N/A | N/A | 7349 | 7368 | CTGCTCCGCCCGTCCCCGTC | 120 | 862 |
| 1048130 | N/A | N/A | 7836 | 7855 | CTGAAAAAGACTCAGTCCCT | 118 | 863 |
| 1048146 | N/A | N/A | 7949 | 7968 | ATATTGGTTGAATCCATCCA | 102 | 864 |
| 1048162 | N/A | N/A | 8211 | 8230 | TCTAACTCCATCTCCTAGCT | 98 | 865 |
| 1048178 | N/A | N/A | 9319 | 9338 | TCACTAATATTTAACATTAA | 84 | 866 |
| 1048194 | N/A | N/A | 9492 | 9511 | GCTGAATTAAGTCCTGAGAC | 55 | 867 |
| 1048210 | N/A | N/A | 9596 | 9615 | TCTTTCCTACTTCTCTCTGC | 82 | 868 |
| 1048226 | N/A | N/A | 9662 | 9681 | AGGCTGTTAAACATGTGGCA | 71 | 869 |
| 1048242 | N/A | N/A | 9807 | 9826 | AGAAGTCCCAACTTAGCCAC | 85 | 870 |
| 1048258 | N/A | N/A | 10580 | 10599 | ACCTGGCTTTCTGAAAACCC | 79 | 871 |
| 1048274 | N/A | N/A | 10698 | 10717 | AGGCTCTTCCAAACGGGCTG | 103 | 872 |
| 1048290 | N/A | N/A | 10768 | 10787 | CCGGCTTCCCCATCGCACCC | 81 | 873 |
| 1048306 | N/A | N/A | 10931 | 10950 | AATCCCTCCTTACCTCTCCA | 116 | 874 |
| 1048322 | N/A | N/A | 11004 | 11023 | TGCCAGCCCCAGGCTTTCCT | 66 | 875 |
| 1048338 | N/A | N/A | 11117 | 11136 | CTCCCCTTAGAACAGCCTAT | 88 | 876 |
| 1048354 | N/A | N/A | 11306 | 11325 | CTGGTAGTTTCCTTTTACCA | 113 | 877 |
| 1048370 | N/A | N/A | 11340 | 11359 | TGGCGGATACGCCAAATCCC | 75 | 878 |
| 1048386 | N/A | N/A | 11555 | 11574 | GAGTTCACACAGACCCCAGG | 85 | 879 |

TABLE 13

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047155 | 121 | 140 | 3569 | 3588 | AGGCCCCCCACCATCATCTC | 124 | 880 |
| 1047171 | 228 | 247 | 3676 | 3695 | CAGCATTGAGTGCCCCAGCC | 104 | 881 |
| 1047187 | 472 | 491 | 3920 | 3939 | TCCCTCTCAACCTCCAGCCG | 7* | 882 |
| 1047203 | 542 | 561 | 4927 | 4946 | GGCTTCCAGCCTCAGGTTGG | 18* | 883 |

TABLE 13-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047219 | 629 | 648 | 5218 | 5237 | CTCCAGCGACTCAATCTTCC | 86 | 884 |
| 1047235 | 761 | 780 | 5647 | 5666 | GATCTCTTTCAGGGCTGCGG | 51 | 885 |
| 1047251 | 1019 | 1038 | 7591 | 7610 | ATAACTGGCCGCCTCCCGCA | 143 | 886 |
| 1047267 | 1223 | 1242 | N/A | N/A | GGTTTCTCGAATCTGCAGGT | 65 | 887 |
| 1047283 | 1280 | 1299 | 10894 | 10913 | CTTCACCACGATGTTCCTCT | 73 | 888 |
| 1047299 | 1323 | 1342 | 11612 | 11631 | GCTTGGACTCCTTAATGACC | 91 | 889 |
| 1047315 | 1396 | 1415 | 11685 | 11704 | TGCTCGGGCCCCTCATGAGA | 84 | 890 |
| 1047331 | 1607 | 1626 | 11896 | 11915 | CCATGCCCCTCCAGACTGCC | 66 | 891 |
| 1047347 | 1658 | 1677 | 11947 | 11966 | CCGCCCTCCTCCCCTTCTCT | 73 | 892 |
| 1047363 | 1721 | 1740 | 12010 | 12029 | TCTGGCAACAGTTTCCATAA | 66 | 893 |
| 1047379 | 1772 | 1791 | 12061 | 12080 | CTGAGGAAACTCAAAGGCAC | 100 | 894 |
| 1047395 | 1837 | 1856 | 12126 | 12145 | GCCAGGGCTACCTTGTCTGT | 80 | 895 |
| 1047411 | 2026 | 2045 | 12315 | 12334 | CATCTTAGACTGATCAGGGT | 72 | 896 |
| 1047427 | 2169 | 2188 | 12458 | 12477 | CAAGCTCCCACCTGCCCACA | 111 | 897 |
| 1047443 | 2232 | 2251 | 12521 | 12540 | TCTATCCCTCCCAGCACCTC | 80 | 898 |
| 1047459 | 2269 | 2288 | 12558 | 12577 | CTCTCTGTACCCACAGCTGG | 85 | 899 |
| 1047475 | 2372 | 2391 | 12661 | 12680 | CCACAACCCCTACTTGTATG | 69 | 900 |
| 1047491 | 2443 | 2462 | 12732 | 12751 | TTTCAGCATCTTCAAGAGGA | 121 | 901 |
| 1047507 | 2471 | 2490 | 12760 | 12779 | CCCATGGATACATCCCCTTT | 79 | 902 |
| 1047523 | 2751 | 2770 | 13040 | 13059 | AGCCAGTGTCTTCACTTTGC | 60 | 903 |
| 1047539 | 2855 | 2874 | 13144 | 13163 | GATCCCACCAGTCTGCTCAC | 84 | 904 |
| 1047555 | 2886 | 2905 | 13175 | 13194 | GTGGGCCCTCCCAGTCCCAT | 81 | 905 |
| 1047571 | 3010 | 3029 | 13299 | 13318 | TGCCCTGAAGATTAGCAGCA | 103 | 906 |
| 1047587 | 3052 | 3071 | 13341 | 13360 | CATTTGTCTTTATTTTTCCT | 14 | 907 |
| 1047603 | N/A | N/A | 8755 | 8774 | TTGTGATTTTCCCCGTCTTT | 75 | 908 |
| 1047619 | N/A | N/A | 8969 | 8988 | ACGCAGTCCAGGCCCTTTAG | 57 | 909 |
| 1047635 | N/A | N/A | 9063 | 9082 | CTCACCACCTTTACCACTAA | 113 | 910 |
| 1047651 | N/A | N/A | 9128 | 9147 | AGAGGTGAGACAGAGGCTGC | 112 | 911 |
| 1047667 | N/A | N/A | 8374 | 8393 | TACTGACCTCGAATCTGCAG | 85 | 912 |
| 1047683 | N/A | N/A | 8432 | 8451 | CCTACAGGCCCTGGAGGAGG | 85 | 913 |
| 1047699 | N/A | N/A | 8476 | 8495 | AGCTGGATCCCTTTGCCCTG | 97 | 914 |
| 1047715 | N/A | N/A | 8630 | 8649 | CTCTCACCCAGTTCTGCTGT | 77 | 915 |
| 1047731 | N/A | N/A | 8723 | 8742 | CCCTGTAGTGACAAGCAGTT | 84 | 916 |
| 1047747 | N/A | N/A | 3997 | 4016 | CCTTCTGCTCACAAGGCCCC | 93 | 917 |
| 1047763 | N/A | N/A | 4257 | 4276 | AAGCCCAGCCATGAATGAAA | 83 | 918 |

TABLE 13-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047779 | N/A | N/A | 4316 | 4335 | AACTCCTCCTTTATATGGAC | 91 | 919 |
| 1047795 | N/A | N/A | 4353 | 4372 | CCAATCTCCCTCATGGACAT | 66 | 920 |
| 1047811 | N/A | N/A | 4386 | 4405 | CTGCTCTTTCCCTCACTTTC | 103 | 921 |
| 1047827 | N/A | N/A | 4516 | 4535 | ATCCCAGGTAACCACCTTTT | 85 | 922 |
| 1047843 | N/A | N/A | 4692 | 4711 | ACTAAGGTGCCTTATCAGGG | 117 | 923 |
| 1047859 | N/A | N/A | 4795 | 4814 | CACCCAGGACCAGTAGAGCA | 56 | 924 |
| 1047875 | N/A | N/A | 4848 | 4867 | ACTTGAATACCTGCCTCAGT | 85 | 925 |
| 1047891 | N/A | N/A | 5001 | 5020 | ATCAATCCTTTCCTCCCTCC | 102 | 926 |
| 1047907 | N/A | N/A | 5107 | 5126 | CTTCTCCCCATTCCTCAGCC | 56 | 927 |
| 1047923 | N/A | N/A | 5349 | 5368 | AGTGTCTCTCTCAGTCTCAG | 83 | 928 |
| 1047939 | N/A | N/A | 5477 | 5496 | CTCTTCTGCCTGCCCCTCGG | 101 | 929 |
| 1047955 | N/A | N/A | 5783 | 5802 | TCCCCCATTCTCTTGTACAG | 49 | 930 |
| 1047971 | N/A | N/A | 5818 | 5837 | GGAGAGGATATTCTCCCAGC | 93 | 931 |
| 1047987 | N/A | N/A | 6007 | 6026 | CTGTCAAAGAACAGCACCTA | 112 | 932 |
| 1048003 | N/A | N/A | 6091 | 6110 | AGAGTTGGAAATCCAACTCT | 92 | 933 |
| 1048019 | N/A | N/A | 6201 | 6220 | GGTCAGACACCTCTCTGTGT | 82 | 934 |
| 1048035 | N/A | N/A | 6321 | 6340 | GCCTAGCCCAAATGCCCCCT | 71 | 935 |
| 1048051 | N/A | N/A | 6384 | 6403 | GCTCTGTCCTCCACTAGGAA | 97 | 936 |
| 1048067 | N/A | N/A | 6504 | 6523 | CCCATCGGGCCCTCACCCTG | 88 | 937 |
| 1048083 | N/A | N/A | 6954 | 6973 | AGAACCTTCCACACTGACAG | 76 | 938 |
| 1048099 | N/A | N/A | 7060 | 7079 | AACAACTGTGACCCATGGAT | 74 | 939 |
| 1048115 | N/A | N/A | 7351 | 7370 | CCCTGCTCCGCCCGTCCCCG | 98 | 940 |
| 1048131 | N/A | N/A | 7837 | 7856 | GCTGAAAAAGACTCAGTOCC | 84 | 941 |
| 1048147 | N/A | N/A | 7973 | 7992 | GTCCTTGGCCTTGAGGCCTA | 95 | 942 |
| 1048163 | N/A | N/A | 8213 | 8232 | AGTCTAACTCCATCTCCTAG | 88 | 943 |
| 1048179 | N/A | N/A | 9322 | 9341 | CATTCACTAATATTTAACAT | 110 | 944 |
| 1048195 | N/A | N/A | 9507 | 9526 | GTTAGCCTTTCTGATGCTGA | 53 | 945 |
| 1048211 | N/A | N/A | 9597 | 9616 | CTCTTTCCTACTTCTCTCTG | 91 | 946 |
| 1048227 | N/A | N/A | 9708 | 9727 | GGCCTACTTCTCTAGGTGGG | 82 | 947 |
| 1048243 | N/A | N/A | 9808 | 9827 | AAGAAGTOCCAACTTAGCCA | 141 | 948 |
| 1048259 | N/A | N/A | 10602 | 10621 | CCTCTGCAAGCCCTGGCCTG | 95 | 949 |
| 1048275 | N/A | N/A | 10699 | 10718 | TAGGCTCTTCCAAACGGGCT | 89 | 950 |
| 1048291 | N/A | N/A | 10769 | 10788 | CCCGGCTTCCCCATCGCACC | 79 | 951 |
| 1048307 | N/A | N/A | 10934 | 10953 | CCAAATCCCTCCTTACCTCT | 156 | 952 |
| 1048323 | N/A | N/A | 11017 | 11036 | GGAACCTTCTATGTGCCAGC | 74 | 953 |

TABLE 13-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048339 | N/A | N/A | 11132 | 11151 | GCTTTGGTACCAAGGCTCCC | 192 | 954 |
| 1048355 | N/A | N/A | 11307 | 11326 | CCTGGTAGTTTCCTTTTACC | 52 | 955 |
| 1048371 | N/A | N/A | 11379 | 11398 | GCTGGAGTAAGATGAGCTOC | 86 | 956 |
| 1048387 | N/A | N/A | 11570 | 11589 | CAGTGCAACAGTTAGGAGTT | 66 | 957 |

TABLE 14

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047156 | 122 | 141 | 3570 | 3589 | CAGGCCCCCCACCATCATCT | 90 | 958 |
| 1047172 | 237 | 256 | 3685 | 3704 | CCTTGAAGCCAGCATTGAGT | 89 | 959 |
| 1047188 | 473 | 492 | 3921 | 3940 | GTCCCTCTCAACCTCCAGCC | 6* | 960 |
| 1047204 | 545 | 564 | 4930 | 4949 | CTCGGCTTCCAGCCTCAGGT | 37* | 961 |
| 1047220 | 634 | 653 | 5223 | 5242 | TCCTCCTCCAGCGACTCAAT | 94 | 962 |
| 1047236 | 766 | 785 | 5652 | 5671 | GTGCGGATCTCTTTCAGGGC | 63 | 963 |
| 1047252 | 1020 | 1039 | 7592 | 7611 | GATAACTGGCCGCCTCCCGC | 113 | 964 |
| 1047268 | 1225 | 1244 | N/A | N/A | CTGGTTTCTCGAATCTGCAG | 83 | 965 |
| 1047284 | 1283 | 1302 | 10897 | 10916 | GGTCTTCACCACGATGTTCC | 94 | 966 |
| 1047300 | 1345 | 1364 | 11634 | 11653 | CACATCACATOCTTGTGCTC | 75 | 967 |
| 1047316 | 1398 | 1417 | 11687 | 11706 | TCTGCTCGGGCCCCTCATGA | 96 | 968 |
| 1047332 | 1608 | 1627 | 11897 | 11916 | GCCATGCCCCTCCAGACTGC | 73 | 969 |
| 1047348 | 1659 | 1678 | 11948 | 11967 | CCCGCCCTCCTCCCCTTCTC | 107 | 970 |
| 1047364 | 1723 | 1742 | 12012 | 12031 | TCTCTGGCAACAGTTTCCAT | 65 | 971 |
| 1047380 | 1773 | 1792 | 12062 | 12081 | CCTGAGGAAACTCAAAGGCA | 92 | 972 |
| 1047396 | 1838 | 1857 | 12127 | 12146 | GGCCAGGGCTACCTTGTCTG | 67 | 973 |
| 1047412 | 2027 | 2046 | 12316 | 12335 | CCATCTTAGACTGATCAGGG | 76 | 974 |
| 1047428 | 2170 | 2189 | 12459 | 12478 | TCAAGCTOCCACCTGCCCAC | 127 | 975 |
| 1047444 | 2233 | 2252 | 12522 | 12541 | CTCTATCCCTCCCAGCACCT | 42 | 976 |
| 1047460 | 2270 | 2289 | 12559 | 12578 | CCTCTCTGTACCCACAGCTG | 94 | 977 |
| 1047476 | 2373 | 2392 | 12662 | 12681 | CCCACAACCCCTACTTGTAT | 115 | 978 |
| 1047492 | 2449 | 2468 | 12738 | 12757 | CTCCTGTTTCAGCATCTTCA | 45 | 979 |
| 1047508 | 2472 | 2491 | 12761 | 12780 | CCCCATGGATACATCCCCTT | 86 | 980 |
| 1047524 | 2759 | 2778 | 13048 | 13067 | GGAATATGAGCCAGTGTCTT | 63 | 981 |

TABLE 14-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047540 | 2857 | 2876 | 13146 | 13165 | CAGATCCCACCAGTCTGCTC | 89 | 982 |
| 1047556 | 2889 | 2908 | 13178 | 13197 | GAAGTGGGCCCTOCCAGTCC | 113 | 983 |
| 1047572 | 3011 | 3030 | 13300 | 13319 | GTGCCCTGAAGATTAGCAGC | 85 | 984 |
| 1047588 | 3053 | 3072 | 13342 | 13361 | GCATTTGTCTTTATTTTTCC | 11 | 985 |
| 1047604 | N/A | N/A | 8756 | 8775 | CTTGTGATTTTCCCCGTCTT | 74 | 986 |
| 1047620 | N/A | N/A | 8972 | 8991 | ATGACGCAGTCCAGGCCCTT | 78 | 987 |
| 1047636 | N/A | N/A | 9064 | 9083 | ACTCACCACCTTTACCACTA | 85 | 988 |
| 1047652 | N/A | N/A | 9129 | 9148 | AAGAGGTGAGACAGAGGCTG | 66 | 989 |
| 1047668 | N/A | N/A | 8375 | 8394 | GTACTGACCTCGAATCTGCA | 96 | 990 |
| 1047684 | N/A | N/A | 8437 | 8456 | AGCAACCTACAGGCCCTGGA | 116 | 991 |
| 1047700 | N/A | N/A | 8477 | 8496 | GAGCTGGATCCCTTTGCCCT | 82 | 992 |
| 1047716 | N/A | N/A | 8631 | 8650 | GCTCTCACCCAGTTCTGCTG | 83 | 993 |
| 1047732 | N/A | N/A | 8725 | 8744 | CCCCCTGTAGTGACAAGCAG | 71 | 994 |
| 1047748 | N/A | N/A | 4051 | 4070 | GAGGTTCGGCCCCTCCCTGA | 68 | 995 |
| 1047764 | N/A | N/A | 4258 | 4277 | AAAGCCCAGCCATGAATGAA | 111 | 996 |
| 1047780 | N/A | N/A | 4317 | 4336 | CAACTCCTCCTTTATATGGA | 104 | 997 |
| 1047796 | N/A | N/A | 4355 | 4374 | ATCCAATCTCCCTCATGGAC | 78 | 998 |
| 1047812 | N/A | N/A | 4388 | 4407 | GCCTGCTCTTTCCCTCACTT | 98 | 999 |
| 1047828 | N/A | N/A | 4520 | 4539 | TCTGATCCCAGGTAACCACC | 81 | 1000 |
| 1047844 | N/A | N/A | 4693 | 4712 | TACTAAGGTGCCTTATCAGG | 92 | 1001 |
| 1047860 | N/A | N/A | 4800 | 4819 | ACCCCCACCCAGGACCAGTA | 94 | 1002 |
| 1047876 | N/A | N/A | 4851 | 4870 | GACACTTGAATACCTGCCTC | 89 | 1003 |
| 1047892 | N/A | N/A | 5002 | 5021 | CATCAATCCTTTOCTOCCTC | 79 | 1004 |
| 1047908 | N/A | N/A | 5109 | 5128 | TCCTTCTCCCCATTCCTCAG | 88 | 1005 |
| 1047924 | N/A | N/A | 5355 | 5374 | TCTCTGAGTGTCTCTCTCAG | 92 | 1006 |
| 1047940 | N/A | N/A | 5478 | 5497 | CCTCTTCTGCCTGCCCCTCG | 111 | 1007 |
| 1047956 | N/A | N/A | 5784 | 5803 | TTCCCCCATTCTCTTGTACA | 98 | 1008 |
| 1047972 | N/A | N/A | 5836 | 5855 | GGTGAAAGTCAGTCACCTGG | 90 | 1009 |
| 1047988 | N/A | N/A | 6009 | 6028 | ATCTGTCAAAGAACAGCACC | 96 | 1010 |
| 1048004 | N/A | N/A | 6092 | 6111 | TAGAGTTGGAAATCCAACTC | 92 | 1011 |
| 1048020 | N/A | N/A | 6211 | 6230 | ACACCTTCCAGGTCAGACAC | 71 | 1012 |
| 1048036 | N/A | N/A | 6322 | 6341 | TGCCTAGCCCAAATGCCCCC | 111 | 1013 |
| 1048052 | N/A | N/A | 6386 | 6405 | AGGCTCTGTCCTCCACTAGG | 87 | 1014 |
| 1048068 | N/A | N/A | 6513 | 6532 | CCTCCCAGCCCCATCGGGCC | 146 | 1015 |
| 1048084 | N/A | N/A | 6955 | 6974 | CAGAACCTTCCACACTGACA | 123 | 1016 |

TABLE 14-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048100 | N/A | N/A | 7065 | 7084 | TTCCCAACAACTGTGACCCA | 69 | 1017 |
| 1048116 | N/A | N/A | 7387 | 7406 | TGGCCCTTCTCCCCTGGCAT | 122 | 1018 |
| 1048132 | N/A | N/A | 7840 | 7859 | AAGGCTGAAAAAGACTCAGT | 82 | 1019 |
| 1048148 | N/A | N/A | 7982 | 8001 | GTGACCCAAGTCCTTGGCCT | 85 | 1020 |
| 1048164 | N/A | N/A | 8217 | 8236 | GGAAAGTCTAACTCCATCTC | 93 | 1021 |
| 1048180 | N/A | N/A | 9323 | 9342 | ACATTCACTAATATTTAACA | 91 | 1022 |
| 1048196 | N/A | N/A | 9510 | 9529 | CTGGTTAGCCTTTCTGATGC | 51 | 1023 |
| 1048212 | N/A | N/A | 9599 | 9618 | TCCTCTTTCCTACTTCTCTC | 73 | 1024 |
| 1048228 | N/A | N/A | 9709 | 9728 | GGGCCTACTTCTCTAGGTGG | 48 | 1025 |
| 1048244 | N/A | N/A | 9813 | 9832 | AGCTCAAGAAGTCCCAACTT | 87 | 1026 |
| 1048260 | N/A | N/A | 10616 | 10635 | GCTTCATTTCAGCCCCTCTG | 82 | 1027 |
| 1048276 | N/A | N/A | 10700 | 10719 | CTAGGCTCTTCCAAACGGGC | 94 | 1028 |
| 1048292 | N/A | N/A | 10771 | 10790 | TGCCCGGCTTCCCCATCGCA | 98 | 1029 |
| 1048308 | N/A | N/A | 10936 | 10955 | GCCCAAATCCCTCCTTACCT | 95 | 1030 |
| 1048324 | N/A | N/A | 11021 | 11040 | GCTGGGAACCTTCTATGTGC | 64 | 1031 |
| 1048340 | N/A | N/A | 11133 | 11152 | GGCTTTGGTACCAAGGCTOC | 89 | 1032 |
| 1048356 | N/A | N/A | 11309 | 11328 | CCCCTGGTAGTTTCCTTTTA | 94 | 1033 |
| 1048372 | N/A | N/A | 11433 | 11452 | TGGTGAGATAACACTGGGAA | 51 | 1034 |
| 1048388 | N/A | N/A | 11571 | 11590 | ACAGTGCAACAGTTAGGAGT | 73 | 1035 |

TABLE 15

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047157 | 123 | 142 | 3571 | 3590 | CCAGGCCCCCCACCATCATC | 116 | 1036 |
| 1047173 | 239 | 258 | 3687 | 3706 | CTCCTTGAAGCCAGCATTGA | 95 | 1037 |
| 1047189 | 474 | 493 | 3922 | 3941 | TGTCCCTCTCAACCTCCAGC | 11* | 1038 |
| 1047205 | 547 | 566 | 4932 | 4951 | TTCTCGGCTTCCAGCCTCAG | 31* | 1039 |
| 1047221 | 637 | 656 | 5226 | 5245 | ATCTCCTCCTCCAGCGACTC | 83 | 1040 |
| 1047237 | 786 | 805 | 5672 | 5691 | ACGCCATTGCCTCATACTGC | 104 | 1041 |
| 1047253 | 1021 | 1040 | 7593 | 7612 | TGATAACTGGCCGCCTCCCG | 94 | 1042 |
| 1047269 | 1227 | 1246 | N/A | N/A | GGCTGGTTTCTCGAATCTGC | 92 | 1043 |

TABLE 15-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047285 | 1285 | 1304 | 10899 | 10918 | ACGGTCTTCACCACGATGTT | 86 | 1044 |
| 1047301 | 1346 | 1365 | 11635 | 11654 | TCACATCACATCCTTGTGCT | 79 | 1045 |
| 1047317 | 1406 | 1425 | 11695 | 11714 | ATCCTGCTTCTGCTCGGGCC | 98 | 1046 |
| 1047333 | 1610 | 1629 | 11899 | 11918 | TGGCCATGCCCCTCCAGACT | 74 | 1047 |
| 1047349 | 1660 | 1679 | 11949 | 11968 | CCCCGCCCTCCTCCCCTTCT | 98 | 1048 |
| 1047365 | 1724 | 1743 | 12013 | 12032 | ATCTCTGGCAACAGTTTCCA | 60 | 1049 |
| 1047381 | 1774 | 1793 | 12063 | 12082 | GCCTGAGGAAACTCAAAGGC | 91 | 1050 |
| 1047397 | 1839 | 1858 | 12128 | 12147 | TGGCCAGGGCTACCTTGTCT | 82 | 1051 |
| 1047413 | 2033 | 2052 | 12322 | 12341 | CCCCACCCATCTTAGACTGA | 84 | 1052 |
| 1047429 | 2172 | 2191 | 12461 | 12480 | AATCAAGCTCCCACCTGCCC | 45 | 1053 |
| 1047445 | 2234 | 2253 | 12523 | 12542 | CCTCTATCCCTCCCAGCACC | 104 | 1054 |
| 1047461 | 2275 | 2294 | 12564 | 12583 | CTTGACCTCTCTGTACCCAC | 67 | 1055 |
| 1047477 | 2375 | 2394 | 12664 | 12683 | CACCCACAACCCCTACTTGT | 97 | 1056 |
| 1047493 | 2450 | 2469 | 12739 | 12758 | TCTCCTGTTTCAGCATCTTC | 58 | 1057 |
| 1047509 | 2478 | 2497 | 12767 | 12786 | CCCTGCCCCCATGGATACAT | 76 | 1058 |
| 1047525 | 2765 | 2784 | 13054 | 13073 | GCTGCAGGAATATGAGCCAG | 84 | 1059 |
| 1047541 | 2858 | 2877 | 13147 | 13166 | ACAGATCCCACCAGTCTGCT | 98 | 1060 |
| 1047557 | 2890 | 2909 | 13179 | 13198 | TGAAGTGGGCCCTCCCAGTC | 87 | 1061 |
| 1047573 | 3016 | 3035 | 13305 | 13324 | CAGCAGTGCCCTGAAGATTA | 45 | 1062 |
| 1047589 | 3054 | 3073 | 13343 | 13362 | AGCATTTGTCTTTATTTTTC | 17 | 1063 |
| 1047605 | N/A | N/A | 8757 | 8776 | CCTTGTGATTTTCCCCGTCT | 64 | 1064 |
| 1047621 | N/A | N/A | 9023 | 9042 | TACAGTTACTCTGTACCACG | 118 | 1065 |
| 1047637 | N/A | N/A | 9065 | 9084 | GACTCACCACCTTTACCACT | 87 | 1066 |
| 1047653 | N/A | N/A | 9199 | 9218 | GATGAAAGAATAAAGCAGAG | 102 | 1067 |
| 1047669 | N/A | N/A | 8376 | 8395 | TGTACTGACCTCGAATCTGC | 90 | 1068 |
| 1047685 | N/A | N/A | 8439 | 8458 | GGAGCAACCTACAGGCCCTG | 104 | 1069 |
| 1047701 | N/A | N/A | 8478 | 8497 | AGAGCTGGATCCCTTTGCCC | 87 | 1070 |
| 1047717 | N/A | N/A | 8632 | 8651 | AGCTCTCACCCAGITCTGCT | 62 | 1071 |
| 1047733 | N/A | N/A | 8731 | 8750 | CTTTTGCCCCCTGTAGTGAC | 56 | 1072 |
| 1047749 | N/A | N/A | 4088 | 4107 | GTGCCCCATCAAGAGGTAGG | 147 | 1073 |
| 1047765 | N/A | N/A | 4260 | 4279 | ACAAAGCCCAGCCATGAATG | 142 | 1074 |
| 1047781 | N/A | N/A | 4318 | 4337 | CCAACTCCTCCTTTATATGG | 74 | 1075 |
| 1047797 | N/A | N/A | 4356 | 4375 | AATCCAATCTCCCTCATGGA | 93 | 1076 |
| 1047813 | N/A | N/A | 4390 | 4409 | CTGCCTGCTCTTTCCCTCAC | 99 | 1077 |
| 1047829 | N/A | N/A | 4521 | 4540 | CTCTGATCCCAGGTAACCAC | 96 | 1078 |

TABLE 15-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047845 | N/A | N/A | 4700 | 4719 | AACTCATTACTAAGGTGCCT | 101 | 1079 |
| 1047861 | N/A | N/A | 4801 | 4820 | CACCCCCACCCAGGACCAGT | 90 | 1080 |
| 1047877 | N/A | N/A | 4852 | 4871 | GGACACTTGAATACCTGCCT | 84 | 1081 |
| 1047893 | N/A | N/A | 5003 | 5022 | CCATCAATCCTTTCCTCCCT | 82 | 1082 |
| 1047909 | N/A | N/A | 5112 | 5131 | GGCTCCTTCTCCCCATTCCT | 92 | 1083 |
| 1047925 | N/A | N/A | 5368 | 5387 | TGTTTCTCTCCTCTCTCTGA | 113 | 1084 |
| 1047941 | N/A | N/A | 5484 | 5503 | TTGTGTCCTCTTCTGCCTGC | 93 | 1085 |
| 1047957 | N/A | N/A | 5786 | 5805 | CCTTCCCCCATTCTCTTGTA | 87 | 1086 |
| 1047973 | N/A | N/A | 5842 | 5861 | TTCTCTGGTGAAAGTCAGTC | 95 | 1087 |
| 1047989 | N/A | N/A | 6012 | 6031 | CTCATCTGTCAAAGAACAGC | 102 | 1088 |
| 1048005 | N/A | N/A | 6110 | 6129 | CTCCCAAGTGAGATGTGCTA | 112 | 1089 |
| 1048021 | N/A | N/A | 6212 | 6231 | CACACCTTCCAGGTCAGACA | 70 | 1090 |
| 1048037 | N/A | N/A | 6323 | 6342 | CTGCCTAGCCCAAATGCCCC | 86 | 1091 |
| 1048053 | N/A | N/A | 6396 | 6415 | TTCTGCCTCCAGGCTCTGTC | 117 | 1092 |
| 1048069 | N/A | N/A | 6519 | 6538 | GGAGGTCCTCCCAGCCCCAT | 94 | 1093 |
| 1048085 | N/A | N/A | 6956 | 6975 | CCAGAACCTTCCACACTGAC | 79 | 1094 |
| 1048101 | N/A | N/A | 7069 | 7088 | ACTTTTCCCAACAACTGTGA | 84 | 1095 |
| 1048117 | N/A | N/A | 7388 | 7407 | CTGGCCCTTCTCCCCTGGCA | 81 | 1096 |
| 1048133 | N/A | N/A | 7841 | 7860 | CAAGGCTGAAAAAGACTCAG | 121 | 1097 |
| 1048149 | N/A | N/A | 7985 | 8004 | AGGGTGACCCAAGTCCTTGG | 89 | 1098 |
| 1048165 | N/A | N/A | 8219 | 8238 | CAGGAAAGTCTAACTCCATC | 80 | 1099 |
| 1048181 | N/A | N/A | 9324 | 9343 | CACATTCACTAATATTTAAC | 93 | 21 |
| 1048197 | N/A | N/A | 9512 | 9531 | GCCTGGTTAGCCTTTCTGAT | 59 | 1100 |
| 1048213 | N/A | N/A | 9604 | 9623 | CCCTTTCCTCTTTCCTACTT | 71 | 1101 |
| 1048229 | N/A | N/A | 9727 | 9746 | TGTAAAATAAGGATGATGGG | 101 | 1102 |
| 1048245 | N/A | N/A | 9816 | 9835 | CAGAGCTCAAGAAGTCCCAA | 101 | 1103 |
| 1048261 | N/A | N/A | 10617 | 10636 | GGCTTCATTTCAGCCCCTCT | 73 | 1104 |
| 1048277 | N/A | N/A | 10702 | 10721 | GCCTAGGCTCTTCCAAACGG | 105 | 1105 |
| 1048293 | N/A | N/A | 10784 | 10803 | CCATCCTCTCCCATGCCCGG | 100 | 1106 |
| 1048309 | N/A | N/A | 10937 | 10956 | GGCCCAAATCCCTCCTTACC | 118 | 1107 |
| 1048325 | N/A | N/A | 11058 | 11077 | CTCTCCTCCAGAATTCCCTG | 76 | 1108 |
| 1048341 | N/A | N/A | 11149 | 11168 | TAGGATCCCATCTAGTGGCT | 51 | 1109 |
| 1048357 | N/A | N/A | 11316 | 11335 | TCCCATTCCCCTGGTAGTTT | 57 | 1110 |
| 1048373 | N/A | N/A | 11435 | 11454 | GGTGGTGAGATAACACTGGG | 88 | 1111 |
| 1048389 | N/A | N/A | 11608 | 11627 | GGACTCCTTAATGACCTGCA | 53 | 1112 |

TABLE 16

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047158 | 124 | 143 | 3572 | 3591 | GCCAGGCCCCCCACCATCAT | 102 | 1113 |
| 1047174 | 240 | 259 | 3688 | 3707 | TCTCCTTGAAGCCAGCATTG | 109 | 1114 |
| 1047190 | 477 | 496 | 3925 | 3944 | GATTGTCCCTCTCAACCTCC | 17* | 1115 |
| 1047206 | 563 | 582 | 4948 | 4967 | ATAGGCAGCCAGGTTGTTCT | 35* | 1116 |
| 1047222 | 638 | 657 | 5227 | 5246 | GATCTCCTCCTCCAGCGACT | 75 | 1117 |
| 1047238 | 809 | 828 | 5695 | 5714 | TTCGGCTTCATGCATGTTGC | 123 | 1118 |
| 1047254 | 1026 | 1045 | 7598 | 7617 | CCTCCTGATAACTGGCCGCC | 117 | 1119 |
| 1047270 | 1228 | 1247 | N/A | N/A | AGGCTGGTTTCTCGAATCTG | 117 | 1120 |
| 1047286 | 1286 | 1305 | 10900 | 10919 | CACGGTCTTCACCACGATGT | 89 | 1121 |
| 1047302 | 1348 | 1367 | 11637 | 11656 | CCTCACATCACATCCTTGTG | 103 | 1122 |
| 1047318 | 1413 | 1432 | 11702 | 11721 | AGCAACTATCCTGCTTCTGC | 58 | 1123 |
| 1047334 | 1612 | 1631 | 11901 | 11920 | GCTGGCCATGCCCCTCCAGA | 114 | 1124 |
| 1047350 | 1661 | 1680 | 11950 | 11969 | CCCCCGCCCTCCTCCCCTTC | 90 | 1125 |
| 1047366 | 1731 | 1750 | 12020 | 12039 | AACCTCCATCTCTGGCAACA | 59 | 1126 |
| 1047382 | 1782 | 1801 | 12071 | 12090 | CTCCAGCAGCCTGAGGAAAC | 131 | 1127 |
| 1047398 | 1844 | 863 | 12133 | 12152 | GCCTCTGGCCAGGGCTACCT | 100 | 1128 |
| 1047414 | 2034 | 2053 | 12323 | 12342 | TCCCCACCCATCTTAGACTG | 113 | 1129 |
| 1047430 | 2178 | 2197 | 12467 | 12486 | GCTGAGAATCAAGCTOCCAC | 54 | 1130 |
| 1047446 | 2235 | 2254 | 12524 | 12543 | CCCTCTATCCCTCCCAGCAC | 100 | 1131 |
| 1047462 | 2278 | 2297 | 12567 | 12586 | GGGCTTGACCTCTCTGTACC | 73 | 1132 |
| 1047478 | 2376 | 2395 | 12665 | 12684 | TCACCCACAACCCCTACTTG | 81 | 1133 |
| 1047494 | 2451 | 2470 | 12740 | 12759 | CTCTCCTGTTTCAGCATCTT | 61 | 1134 |
| 1047510 | 2481 | 2500 | 12770 | 12789 | ATGCCCTGCCCCCATGGATA | 83 | 1135 |
| 1047526 | 2777 | 2796 | 13066 | 13085 | CCCGGCCTCCAGGCTGCAGG | 89 | 1136 |
| 1047542 | 2859 | 2878 | 13148 | 13167 | CACAGATCCCACCAGTCTGC | 85 | 1137 |
| 1047558 | 2901 | 2920 | 13190 | 13209 | GAGGAGAACCCTGAAGTGGG | 95 | 1138 |
| 1047574 | 3018 | 3037 | 13307 | 13326 | AGCAGCAGTGCCCTGAAGAT | 78 | 1139 |
| 1047590 | 3055 | 3074 | 13344 | 13363 | CAGCATTTGTCTTTATTTTT | 21 | 1140 |
| 1047606 | N/A | N/A | 8758 | 8777 | ACCTTGTGATTTTCCCCGTC | 70 | 1141 |
| 1047622 | N/A | N/A | 9024 | 9043 | GTACAGTTACTCTGTACCAC | 138 | 1142 |
| 1047638 | N/A | N/A | 9066 | 9085 | GGACTCACCACCTTTACCAC | 68 | 1143 |
| 1047654 | N/A | N/A | 9200 | 9219 | GGATGAAAGAATAAAGCAGA | 85 | 1144 |
| 1047670 | N/A | N/A | 8377 | 8396 | CTGTACTGACCTCGAATCTG | 93 | 1145 |
| 1047686 | N/A | N/A | 8443 | 8462 | GTCTGGAGCAACCTACAGGC | 79 | 1146 |
| 1047702 | N/A | N/A | 8495 | 8514 | CACGAAGGCCCCCAGGGAGA | 77 | 1147 |

TABLE 16-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047718 | N/A | N/A | 8633 | 8652 | AAGCTCTCACCCAGTTCTGC | 108 | 1148 |
| 1047734 | N/A | N/A | 8733 | 8752 | TGCTTTTGCCCCCTGTAGTG | 47 | 1149 |
| 1047750 | N/A | N/A | 4090 | 4109 | TAGTGCCCCATCAAGAGGTA | 88 | 1150 |
| 1047766 | N/A | N/A | 4262 | 4281 | TCACAAAGCCCAGCCATGAA | 89 | 1151 |
| 1047782 | N/A | N/A | 4319 | 4338 | TCCAACTCCTCCTTTATATG | 85 | 1152 |
| 1047798 | N/A | N/A | 4357 | 4376 | GAATCCAATCTCCCTCATGG | 94 | 1153 |
| 1047814 | N/A | N/A | 4396 | 4415 | CCAGACCTGCCTGCTCTTTC | 89 | 1154 |
| 1047830 | N/A | N/A | 4523 | 4542 | TCCTCTGATCCCAGGTAACC | 76 | 1155 |
| 1047846 | N/A | N/A | 4701 | 4720 | TAACTCATTACTAAGGTGCC | 79 | 1156 |
| 1047862 | N/A | N/A | 4804 | 4823 | GACCACCCCCACCCAGGACC | 105 | 1157 |
| 1047878 | N/A | N/A | 4853 | 4872 | AGGACACTTGAATACCTGCC | 56 | 1158 |
| 1047894 | N/A | N/A | 5004 | 5023 | GCCATCAATCCTTTCCTCCC | 100 | 1159 |
| 1047910 | N/A | N/A | 5113 | 5132 | AGGCTOCTTCTCCCCATTCC | 90 | 1160 |
| 1047926 | N/A | N/A | 5379 | 5398 | CTGCCAATCTCTGTTTCTCT | 85 | 1161 |
| 1047942 | N/A | N/A | 5496 | 5515 | TTCCCCACGCCATTGTGTCC | 76 | 1162 |
| 1047958 | N/A | N/A | 5787 | 5806 | TCCTTCCCCCATTCTCTTGT | 121 | 1163 |
| 1047974 | N/A | N/A | 5851 | 5870 | CCATCTCACTTCTCTGGTGA | 82 | 1164 |
| 1047990 | N/A | N/A | 6019 | 6038 | CGGCTCTCTCATCTGTCAAA | 43 | 1165 |
| 1048006 | N/A | N/A | 6115 | 6134 | GCAGGCTCCCAAGTGAGATG | 99 | 1166 |
| 1048022 | N/A | N/A | 6221 | 6240 | CGTCAATATCACACCTTCCA | 96 | 1167 |
| 1048038 | N/A | N/A | 6324 | 6343 | CCTGCCTAGCCCAAATGCCC | 119 | 1168 |
| 1048054 | N/A | N/A | 6400 | 6419 | GCTTTTCTGCCTCCAGGCTC | 77 | 1169 |
| 1048070 | N/A | N/A | 6539 | 6558 | CCTTTCTCCCCTGCCTGCAG | 89 | 1170 |
| 1048086 | N/A | N/A | 6957 | 6976 | TCCAGAACCTTCCACACTGA | 82 | 1171 |
| 1048102 | N/A | N/A | 7070 | 7089 | GACTTTTCCCAACAACTGTG | 84 | 1172 |
| 1048118 | N/A | N/A | 7390 | 7409 | CCCTGGCCCTTCTCCCCTGG | 76 | 1173 |
| 1048134 | N/A | N/A | 7842 | 7861 | ACAAGGCTGAAAAAGACTCA | 83 | 1174 |
| 1048150 | N/A | N/A | 7986 | 8005 | GAGGGTGACCCAAGTCCTTG | 110 | 1175 |
| 1048166 | N/A | N/A | 8221 | 8240 | GCCAGGAAAGTCTAACTCCA | 75 | 1176 |
| 1048182 | N/A | N/A | 9326 | 9345 | GTCACATTCACTAATATTTA | 44 | 1177 |
| 1048198 | N/A | N/A | 9525 | 9544 | CCTCTACTAGTCAGCCTGGT | 65 | 1178 |
| 1048214 | N/A | N/A | 9606 | 9625 | TCCCCTTTCCTCTTTCCTAC | 75 | 1179 |
| 1048230 | N/A | N/A | 9772 | 9791 | CTCTGGGCAAGTTAATTGAC | 122 | 1180 |
| 1048246 | N/A | N/A | 9818 | 9837 | ACCAGAGCTCAAGAAGTCCC | 83 | 1181 |
| 1048262 | N/A | N/A | 10618 | 10637 | TGGCTTCATTTCAGCCCCTC | 81 | 1182 |

TABLE 16-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048278 | N/A | N/A | 10710 | 10729 | CAGAGAGAGCCTAGGCTCTT | 95 | 1183 |
| 1048294 | N/A | N/A | 10788 | 10807 | TGAGCCATCCTCTCCCATGC | 125 | 1184 |
| 1048310 | N/A | N/A | 10940 | 10959 | CTGGGCCCAAATCCCTCCTT | 83 | 1185 |
| 1048326 | N/A | N/A | 11060 | 11079 | TGCTCTCCTCCAGAATTCCC | 123 | 1186 |
| 1048342 | N/A | N/A | 11223 | 11242 | CTAACTTTAATTCTCTTTCT | 114 | 1187 |
| 1048358 | N/A | N/A | 11317 | 11336 | TTCCCATTCCCCTGGTAGTT | 89 | 1188 |
| 1048374 | N/A | N/A | 11436 | 11455 | GGGTGGTGAGATAACACTGG | 106 | 1189 |
| 1048390 | N/A | N/A | 11609 | 11628 | TGGACTCCTTAATGACCTGC | 68 | 1190 |

TABLE 17

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047159 | 126 | 145 | 3574 | 3593 | GAGCCAGGCCCCCCACCATC | 104 | 1191 |
| 1047175 | 244 | 263 | 3692 | 3711 | CGGGTCTCCTTGAAGCCAGC | 125 | 1192 |
| 1047191 | 480 | 499 | 3928 | 3947 | CCAGATTGTCCCTCTCAACC | 15* | 1193 |
| 1047207 | 574 | 593 | N/A | N/A | GCTTCCTGTCTATAGGCAGC | 37* | 1194 |
| 1047223 | 639 | 658 | 5228 | 5247 | GGATCTCCTCCTCCAGCGAC | 79 | 1195 |
| 1047239 | 811 | 830 | 5697 | 5716 | TCTTCGGCTTCATGCATGTT | 98 | 1196 |
| 1047255 | 1028 | 1047 | 7600 | 7619 | CGCCTCCTGATAACTGGCCG | 105 | 1197 |
| 1047271 | 1241 | 1260 | 10855 | 10874 | AGACTTGGTGTCCAGGCTGG | 79 | 1198 |
| 1047287 | 1289 | 1308 | 0903 | 10922 | CTCCACGGTCTTCACCACGA | 138 | 1199 |
| 1047303 | 1349 | 1368 | 11638 | 11657 | GCCTCACATCACATCCTTGT | 113 | 1200 |
| 1047319 | 1414 | 1433 | 11703 | 11722 | GAGCAACTATCCTGCTTCTG | 68 | 1201 |
| 1047335 | 1615 | 1634 | 11904 | 11923 | GCTGCTGGCCATGCCCCTCC | 123 | 1202 |
| 1047351 | 1663 | 1682 | 11952 | 11971 | GCCCCCCGCCCTCCTCCCCT | 73 | 1203 |
| 1047367 | 1734 | 1753 | 12023 | 12042 | GAGAACCTCCATCTCTGGCA | 67 | 1204 |
| 1047383 | 1790 | 1809 | 12079 | 12098 | CAGTTTTCCTCCAGCAGCCT | 109 | 11 |
| 1047399 | 1853 | 1872 | 12142 | 12161 | ACAAAACAAGCCTCTGGCCA | 90 | 1206 |
| 1047415 | 2035 | 2054 | 12324 | 12343 | GTCCCCACCCATCTTAGACT | 76 | 1207 |
| 1047431 | 2179 | 2198 | 12468 | 12487 | TGCTGAGAATCAAGCTCCCA | 91 | 1208 |
| 1047447 | 2236 | 2255 | 12525 | 12544 | CCCCTCTATCCCTOCCAGCA | 83 | 1209 |
| 1047463 | 2279 | 2298 | 12568 | 12587 | TGGGCTTGACCTCTCTGTAC | 103 | 1210 |

TABLE 17-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1047479 | 2377 | 2396 | 12666 | 12685 | GTCACCCACAACCCCTACTT | 88 | 1211 |
| 1047495 | 2456 | 2475 | 2745 | 12764 | CCTTTCTCTCCTGTTTCAGC | 54 | 1212 |
| 1047511 | 2482 | 2501 | 12771 | 12790 | CATGCCCTGCCCCCATGGAT | 83 | 1213 |
| 1047527 | 2779 | 2798 | 13068 | 13087 | CACCCGGCCTCCAGGCTGCA | 106 | 1214 |
| 1047543 | 2860 | 2879 | 13149 | 13168 | GCACAGATCCCACCAGTCTG | 108 | 1215 |
| 1047559 | 2902 | 2921 | 13191 | 13210 | AGAGGAGAACCCTGAAGTGG | 120 | 1216 |
| 1047575 | 3034 | 3053 | 13323 | 13342 | CTCAGCGACTAAAGGCAGCA | 59 | 1217 |
| 1047591 | 3056 | 3075 | 13345 | 13364 | GCAGCATTTGTCTTTATTTT | 22 | 1218 |
| 1047607 | N/A | N/A | 8760 | 8779 | TGACCTTGTGATTTTCCCCG | 59 | 1219 |
| 1047623 | N/A | N/A | 9025 | 9044 | TGTACAGTTACTCTGTACCA | 103 | 1220 |
| 1047639 | N/A | N/A | 9067 | 9086 | AGGACTCACCACCTTTACCA | 77 | 1221 |
| 1047655 | N/A | N/A | 9201 | 9220 | GGGATGAAAGAATAAAGCAG | 67 | 1222 |
| 1047671 | N/A | N/A | 8378 | 8397 | GCTGTACTGACCTCGAATCT | 94 | 1223 |
| 1047687 | N/A | N/A | 8453 | 8472 | CTCAGTCCCAGTCTGGAGCA | 123 | 1224 |
| 1047703 | N/A | N/A | 8502 | 8521 | GCAGTGTCACGAAGGCCCCC | 89 | 1225 |
| 1047719 | N/A | N/A | 8635 | 8654 | TCAAGCTCTCACCCAGTTCT | 96 | 1226 |
| 1047735 | N/A | N/A | 8735 | 8754 | GGTGCTTTTGCCCCCTGTAG | 55 | 1227 |
| 1047751 | N/A | N/A | 4091 | 4110 | ATAGTGCCCCATCAAGAGGT | 135 | 1228 |
| 1047767 | N/A | N/A | 4263 | 4282 | GTCACAAAGCCCAGCCATGA | 122 | 1229 |
| 1047783 | N/A | N/A | 4321 | 4340 | CTTCCAACTCCTCCTTTATA | 95 | 1230 |
| 1047799 | N/A | N/A | 4358 | 4377 | AGAATCCAATCTCCCTCATG | 67 | 1231 |
| 1047815 | N/A | N/A | 4399 | 4418 | CGCCCAGACCTGCCTGCTCT | 94 | 1232 |
| 1047831 | N/A | N/A | 4524 | 4543 | TTCCTCTGATCCCAGGTAAC | 86 | 1233 |
| 1047847 | N/A | N/A | 4702 | 4721 | TTAACTCATTACTAAGGTGC | 87 | 1234 |
| 1047863 | N/A | N/A | 4805 | 4824 | AGACCACCCCCACCCAGGAC | 96 | 1235 |
| 1047879 | N/A | N/A | 4866 | 4885 | CCAGGCTCTTCTGAGGACAC | 119 | 1236 |
| 1047895 | N/A | N/A | 5005 | 5024 | GGCCATCAATCCTTTCCTCC | 81 | 1237 |
| 1047911 | N/A | N/A | 5115 | 5134 | CCAGGCTCCTTCTCCCCATT | 92 | 1238 |
| 1047927 | N/A | N/A | 5385 | 5404 | CTCTACCTGCCAATCTCTGT | 86 | 1239 |
| 1047943 | N/A | N/A | 5497 | 5516 | GTTCCCCACGCCATTGTGTC | 78 | 1240 |
| 1047959 | N/A | N/A | 5788 | 5807 | CTCCTTCCCCCATTCTCTTG | 104 | 1241 |
| 1047975 | N/A | N/A | 5933 | 5952 | GCTACTACTAATAATAGCAA | 99 | 1242 |
| 1047991 | N/A | N/A | 6021 | 6040 | TTCGGCTCTCTCATCTGTCA | 80 | 1243 |
| 1048007 | N/A | N/A | 6117 | 6136 | ATGCAGGCTCCCAAGTGAGA | 88 | 1244 |
| 1048023 | N/A | N/A | 6280 | 6299 | CCACACTACATATAAGCTCT | 163 | 1245 |

TABLE 17-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP RNA (% control) | SEQ ID NO |
|---|---|---|---|---|---|---|---|
| 1048039 | N/A | N/A | 6325 | 6344 | TCCTGCCTAGCCCAAATGCC | 100 | 1246 |
| 1048055 | N/A | N/A | 6403 | 6422 | TGTGCTTTTCTGCCTCCAGG | 52 | 1247 |
| 1048071 | N/A | N/A | 6543 | 6562 | TAGCCCTTTCTCCCCTGCCT | 77 | 1248 |
| 1048087 | N/A | N/A | 6958 | 6977 | ATCCAGAACCTTCCACACTG | 88 | 1249 |
| 1048103 | N/A | V/A | 7072 | 7091 | GGGACTTTTOCCAACAACTG | 68 | 1250 |
| 1048119 | N/A | N/A | 7393 | 7412 | CGTCCCTGGCCCTTCTCCCC | 77 | 1251 |
| 1048135 | N/A | N/A | 7843 | 7862 | CACAAGGCTGAAAAAGACTC | 94 | 1252 |
| 1048151 | N/A | N/A | 7987 | 8006 | GGAGGGTGACCCAAGTCCTT | 35 | 1253 |
| 1048167 | N/A | N/A | 8222 | 8241 | TGCCAGGAAAGTCTAACTCC | 77 | 1254 |
| 1048183 | N/A | N/A | 9362 | 9381 | TCCCCCCGCCCCGCCCGAGA | 88 | 1255 |
| 1048199 | N/A | N/A | 9533 | 9552 | CAGTATTACCTCTACTAGTC | 64 | 20 |
| 1048215 | N/A | N/A | 9609 | 9628 | CTGTCCCCTTTCCTCTTTCC | 98 | 1256 |
| 1048231 | N/A | N/A | 9788 | 9807 | CCAACCAGCCACATGACTCT | 91 | 1257 |
| 1048247 | N/A | N/A | 9825 | 9844 | TCAGGAGACCAGAGCTCAAG | 93 | 1258 |
| 1048263 | N/A | N/A | 10620 | 10639 | CCTGGCTTCATTTCAGCCCC | 87 | 1259 |
| 1048279 | N/A | N/A | 10711 | 10730 | GCAGAGAGAGCCTAGGCTCT | 143 | 1260 |
| 1048295 | N/A | N/A | 10792 | 10811 | GGCATGAGCCATCCTCTCCC | 123 | 1261 |
| 1048311 | N/A | N/A | 10941 | 10960 | ACTGGGCCCAAATCCCTCCT | 104 | 1262 |
| 1048327 | N/A | N/A | 11061 | 11080 | TTGCTCTCCTCCAGAATTCC | 97 | 1263 |
| 1048343 | N/A | N/A | 11226 | 11245 | CTACTAACTTTAATTCTCTT | 97 | 1264 |
| 1048359 | N/A | N/A | 11318 | 11337 | CTTCCCATTCCCCTGGTAGT | 86 | 1265 |
| 1048375 | N/A | N/A | 11487 | 11506 | GTCTTACTTTTCTTGATAGT | 94 | 1266 |
| 1048391 | N/A | N/A | 11610 | 11629 | TTGGACTCCTTAATGACCTG | 86 | 1267 |

Example 2: Effect of 5-10-5 MOE Gapmer Modified Oligonucleotides on Human GFAP RNA In Vitro, Single Dose Modified oligonucleotides complementary to human GFAP nucleic acid were designed and tested for their single dose effects on GFAP RNA in vitro. The modified oligonucleotides were tested in a series of experiments that had similar culture conditions.

The modified oligonucleotides in the tables below are 5-10-5 MOE gapmers with mixed PO/PS internucleoside linkages. The gapmers are 20 nucleosides in length, wherein the central gap segment consists of ten 2'-β-D-deoxynucleosides and the 5' and 3' wing segments each consists of five 2'-β-D-MOE modified nucleosides. The sugar motif for the gapmers is (from 5' to 3'): eeeeeddddddddddeeeee: wherein 'd' represents a 2'-β-D-deoxyribosyl sugar moiety, and 'e' represents a 2'-β-D-MOE sugar moiety. The internucleoside linkage motif for the gapmers is (from 5' to 3'): sooosssssssssssooss; wherein each 'o' represents a phosphodiester internucleoside linkage and each 's' represents a phosphorothioate internucleoside linkage. Each cytosine residue is a 5-methylcytosine.

"Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the Tables below is 100% complementary to SEQ ID NO: 1, SEQ ID NO: 2, or SEQ ID NO: 3 (GENBANK Accession No. NM_001131019.2). 'N/A' indicates that the modified oligonucleotide is not 100% complementary to that particular gene sequence.

Cultured U251 cells were treated with modified oligonucleotide at a concentration of 4,000 nM using free uptake at a density of 10,000 cells per well. After a treatment period of approximately 48 hours, total RNA was isolated from the cells and GFAP RNA levels were measured by quantitative real-time RTPCR. Human GFAP primer probe set RTS37485, described in Example 1 above, was used to measure RNA levels. GFAP RNA levels were nominalized to total RNA content, as measured by RIBOGREEN®. Results are presented in the tables below as percent GFAP RNA levels relative to untreated control cells. The values marked with an asterisk (*) indicate that the modified oligonucleotide is complementary to the amplicon region of the primer probe set. Additional assays may be used to measure the potency and efficacy of the modified oligonucleotides complementary to the amplicon region.

TABLE 18

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 8 | 517 |
| 1072810 | 1708 | 1727 | 11997 | 12016 | TCCATAACAACAGGAATCAG | 65 | 1268 |
| 1072814 | 1719 | 1738 | 12008 | 12027 | TGGCAACAGTTTCCATAACA | 31 | 1269 |
| 1072818 | 1728 | 1747 | 12017 | 12036 | CTCCATCTCTGGCAACAGTT | 42 | 1270 |
| 1072822 | 1752 | 1771 | 12041 | 12060 | AGTTCCCAGATACTCCGAGA | 56 | 1271 |
| 1072826 | 1763 | 1782 | 12052 | 12071 | CTCAAAGGCACAGTTCCCAG | 56 | 1272 |
| 1072830 | 1786 | 1805 | 12075 | 12094 | TTTCCTCCAGCAGCCTGAGG | 79 | 1273 |
| 1072834 | 1796 | 1815 | 12085 | 12104 | GAGTCTCAGTTTTCCTCCAG | 18 | 1274 |
| 1072838 | 2173 | 2192 | 12462 | 12481 | GAATCAAGCTCCCACCTGCC | 87 | 1275 |
| 1072842 | 2177 | 2196 | 12466 | 12485 | CTGAGAATCAAGCTCCCACC | 94 | 1276 |
| 1072846 | 3039 | 3058 | 13328 | 13347 | TTTTCCTCAGCGACTAAAGG | 48 | 1277 |
| 1072850 | 3059 | 3078 | 13348 | 13367 | GGCGCAGCATTTGTCTTTAT | 45 | 1278 |
| 1072854 | N/A | N/A | 8768 | 8787 | ATATCTTGTGACCTTGTGAT | 53 | 1279 |
| 1072858 | N/A | N/A | 8774 | 8793 | TTTGAGATATCTTGTGACCT | 66 | 1280 |
| 1072862 | N/A | N/A | 8780 | 8799 | GAGGCTTTTGAGATATCTTG | 28 | 1281 |
| 1072866 | N/A | N/A | 8785 | 8804 | ATTGTGAGGCTTTTGAGATA | 66 | 1282 |
| 1072870 | N/A | N/A | 7980 | 7999 | GACCCAAGTCCTTGGCCTTG | 81 | 1283 |
| 1072874 | N/A | N/A | 7990 | 8009 | TTTGGAGGGTGACCCAAGTC | 78 | 1284 |
| 1072878 | N/A | N/A | 7997 | 8016 | CTCTTAGTTTGGAGGGTGAC | 61 | 1285 |
| 1072882 | N/A | N/A | 11296 | 11315 | CCTTTTACCAAGCTGGAAAT | 73 | 1286 |
| 1072886 | N/A | N/A | 11303 | 11322 | GTAGTTTCCTTTTACCAAGC | 34 | 1287 |
| 1072890 | N/A | N/A | 4033 | 4052 | GAGACTTCTCGGGCACTOCT | 75 | 1288 |
| 1072894 | N/A | N/A | 4133 | 4152 | TGGGCCTGTTTCTGGTCCCT | 63 | 1289 |
| 1072898 | N/A | N/A | 4208 | 4227 | TTCCCCAGTAGGGAGGTGCT | 100 | 1290 |
| 1072902 | N/A | N/A | 4285 | 4304 | ATAGGTGAGCTCGCTGCCCA | 82 | 1291 |
| 1072906 | N/A | N/A | 4297 | 4316 | CACAGGCTCAGAATAGGTGA | 68 | 1292 |
| 1072910 | N/A | N/A | 4458 | 4477 | CAAGTCAAAGTAACTTGATG | 80 | 1293 |
| 1072914 | N/A | N/A | 4492 | 4511 | TGAATTTTATTATGACCACC | 64 | 1294 |
| 1072918 | N/A | N/A | 4564 | 4583 | CATGTCCTGTCAGCTCAGTG | 61 | 1295 |
| 1072922 | N/A | N/A | 4638 | 4657 | CACAAGCATACACTCACTGT | 84 | 1296 |
| 1072926 | N/A | N/A | 4677 | 4696 | CAGGGTTGGTGCACCTGCTT | 74 | 1297 |

TABLE 18-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1072930 | N/A | N/A | 4748 | 4767 | TAGACAGAGGACTTGTCTGG | 96 | 1298 |
| 1072934 | N/A | N/A | 4826 | 4845 | CCCTTGAGGCAGCTGTCACA | 87 | 1299 |
| 1072938 | N/A | N/A | 5049 | 5068 | CATTGCTCTGGCGGGCTGAG | 89 | 1300 |
| 1072942 | N/A | N/A | 5296 | 5315 | CAATCTCTGTGTTGAGCTTT | 70 | 1301 |
| 1072946 | N/A | N/A | 5396 | 5415 | TCATTTCCTGTCTCTACCTG | 85 | 1302 |
| 1072950 | N/A | N/A | 5549 | 5568 | GACCAGGGTGAGAGAAGCGG | 78 | 1303 |
| 1072954 | N/A | N/A | 5745 | 5764 | GAGGAGGCAGGCTGGCCCAC | 84 | 1304 |
| 1072958 | N/A | N/A | 5900 | 5919 | AATAATGGGTACTTTTGAAA | 88 | 1305 |
| 1072962 | N/A | N/A | 5986 | 6005 | TTCATAGTAAGGTAATCCAT | 75 | 1306 |
| 1072966 | N/A | N/A | 6032 | 6051 | CCTCTCTGGACTTCGGCTCT | 81 | 1307 |
| 1072970 | N/A | N/A | 6240 | 6259 | GGCACTATGTTTGGGTGCAC | 85 | 1308 |
| 1072974 | N/A | N/A | 6302 | 6321 | TCTACAGTGTCTTTCCTGGC | 67 | 1309 |
| 1072978 | N/A | N/A | 6446 | 6465 | CTAGGTGCCCTGGCTAGGCT | 72 | 1310 |
| 1072982 | N/A | N/A | 6524 | 6543 | TGCAGGGAGGTCCTCCCAGC | 96 | 1311 |
| 1072986 | N/A | N/A | 6901 | 6920 | GCGAGCGGAGGCCTGGGTGT | 26 | 1312 |
| 1072990 | N/A | N/A | 6942 | 6961 | ACTGACAGCTGCATCTGCGG | 79 | 1313 |
| 1072994 | N/A | N/A | 6985 | 7004 | AAGCGAATGAATGAACAGTG | 69 | 1314 |
| 1072998 | N/A | N/A | 7079 | 7098 | CCTGGCTGGGACTTTTCCCA | 84 | 1315 |
| 1073002 | N/A | N/A | 7119 | 7138 | GGGAGGTGAGCAGCACCCCA | 84 | 1316 |
| 1073006 | N/A | N/A | 7358 | 7377 | TGGCCGTCCCTGCTCCGCCC | 96 | 1317 |
| 1073010 | N/A | N/A | 7510 | 7529 | GGCCGGTCCCGCGGAGCCCC | 86 | 1318 |
| 1073014 | N/A | N/A | 7521 | 7540 | GGGATGGAGCCGGCCGGTCC | 77 | 1319 |
| 1073018 | N/A | N/A | 7785 | 7804 | AGCAGGGAGACTTCCCCAGG | 85 | 1320 |
| 1073022 | N/A | N/A | 7827 | 7846 | ACTCAGTCCCTGAAGGGAGC | 90 | 1321 |
| 1073026 | N/A | N/A | 7898 | 7917 | CTGCTATGTGTGAGGCAGGC | 83 | 1322 |
| 1073030 | N/A | N/A | 8027 | 8046 | CAATCTTGGCTGGGAAGATG | 90 | 1323 |
| 1073034 | N/A | N/A | 8048 | 8067 | AGATGGGTGAGGTGAGGAGT | 33 | 1324 |
| 1073038 | N/A | N/A | 8231 | 8250 | CCTTTTCCTTGCCAGGAAAG | 76 | 1325 |
| 1073042 | N/A | N/A | 9380 | 9399 | AGTAATTTAGCTCCCCCCTC | 76 | 1326 |
| 1073046 | N/A | N/A | 9410 | 9429 | AGAATCATTTCAGGGCCAAT | 67 | 1327 |
| 1073050 | N/A | N/A | 9438 | 9457 | GAAGAAGAGGAATTTTGTTC | 82 | 1328 |
| 1073054 | N/A | N/A | 9486 | 9505 | TTAAGTCCTGAGACATGCAT | 55 | 1329 |
| 1073058 | N/A | N/A | 9500 | 9519 | TTTCTGATGCTGAATTAAGT | 88 | 1330 |
| 1073062 | N/A | N/A | 9543 | 9562 | TAGGATTTGGCAGTATTACC | 62 | 1331 |
| 1073066 | N/A | N/A | 9649 | 9668 | TGTGGCACATATTAGTGCTC | 76 | 1332 |
| 1073070 | N/A | N/A | 10001 | 10020 | AATCCCCTTACTCGGGAGTC | 76 | 1333 |

TABLE 18-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1073074 | N/A | N/A | 10551 | 10570 | TTGAAATCAGGAGACCAGGA | 73 | 1334 |
| 1073078 | N/A | N/A | 10567 | 10586 | AAAACCCAGCACGGTATTGA | 73 | 1335 |
| 1073082 | N/A | N/A | 10715 | 10734 | CCGAGCAGAGAGAGCCTAGG | 88 | 1336 |
| 1073086 | N/A | N/A | 10805 | 10824 | CATGGACTTTCAGGGCATGA | 90 | 1337 |
| 1073090 | N/A | N/A | 11105 | 11124 | CAGCCTATGGAGGGACTGAG | 88 | 1338 |
| 1073094 | N/A | N/A | 11165 | 11184 | AAGAGAGAGTGTGTATTAGG | 63 | 1339 |
| 1073098 | N/A | N/A | 11208 | 11227 | TTTCTCTCCCTGGCAAGCAA | 65 | 1340 |
| 1073102 | N/A | N/A | 11256 | 11275 | AACTGTGTCTGCTAGAGTTG | 66 | 1341 |
| 1073106 | N/A | N/A | 11386 | 11405 | GTAAGCTGCTGGAGTAAGAT | 45 | 1342 |
| 1073110 | N/A | N/A | 11472 | 11491 | ATAGTAACCACAGCTGOCTT | 81 | 1343 |
| 1073114 | N/A | N/A | 11516 | 11535 | GTAACCTTGGGAAGTCCCCG | 75 | 1344 |

TABLE 19

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 7 | 517 |
| 1072811 | 1711 | 1730 | 12000 | 12019 | GTTTCCATAACAACAGGAAT | 82 | 1345 |
| 1072815 | 1720 | 1739 | 12009 | 12028 | CTGGCAACAGTTTCCATAAC | 40 | 1346 |
| 1072819 | 1746 | 1765 | 12035 | 12054 | CAGATACTCCGAGAGAACCT | 75 | 1347 |
| 1072823 | 1753 | 1772 | 12042 | 12061 | CAGTTOCCAGATACTCCGAG | 65 | 1348 |
| 1072827 | 1766 | 1785 | 12055 | 12074 | AAACTCAAAGGCACAGTTCC | 99 | 1349 |
| 1072831 | 1787 | 1806 | 12076 | 12095 | TTTTCCTCCAGCAGCCTGAG | 85 | 1350 |
| 1072835 | 1797 | 1816 | 12086 | 12105 | TGAGTCTCAGTTTTCCTCCA | 18 | 1351 |
| 1072839 | 2174 | 2193 | 12463 | 12482 | AGAATCAAGCTCCCACCTGC | 82 | 1352 |
| 1072843 | 3036 | 3055 | 13325 | 13344 | TCCTCAGCGACTAAAGGCAG | 54 | 1353 |
| 1072847 | 3041 | 3060 | 13330 | 13349 | ATTTTTCCTCAGCGACTAAA | 55 | 1354 |
| 1072851 | 3061 | 3080 | 13350 | 13369 | AGGGCGCAGCATTTGTCTTT | 55 | 1355 |
| 1072855 | N/A | N/A | 8771 | 8790 | GAGATATCTTGTGACCTTGT | 37 | 1356 |
| 1072859 | N/A | N/A | 8775 | 8794 | TTTTGAGATATCTTGTGACC | 60 | 1357 |
| 1072863 | N/A | N/A | 8781 | 8800 | TGAGGCTTTTGAGATATCTT | 34 | 1358 |
| 1072867 | N/A | N/A | 8786 | 8805 | TATTGTGAGGCTTTIGAGAT | 60 | 1359 |
| 1072871 | N/A | N/A | 7983 | 8002 | GGTGACCCAAGTCCTTGGCC | 76 | 1360 |

TABLE 19-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1072875 | N/A | N/A | 7991 | 8010 | GTTTGGAGGGTGACCCAAGT | 70 | 1361 |
| 1072879 | N/A | N/A | 11290 | 11309 | ACCAAGCTGGAAATGGAAAG | 70 | 1362 |
| 1072883 | N/A | N/A | 11297 | 11316 | TCCTTTTACCAAGCTGGAAA | 83 | 1363 |
| 1072887 | N/A | N/A | 11304 | 11323 | GGTAGTTTCCTTTTACCAAG | 49 | 1364 |
| 1072891 | N/A | N/A | 4035 | 4054 | CTGAGACTTCTCGGGCACTC | 87 | 1365 |
| 1072895 | N/A | N/A | 4162 | 4181 | GGCATGCGGGCATCAGATCC | 87 | 1366 |
| 1072899 | N/A | N/A | 4221 | 4240 | CTCCTGCACTGCTTTCCCCA | 64 | 1367 |
| 1072903 | N/A | N/A | 4287 | 4306 | GAATAGGTGAGCTCGCTGCC | 89 | 1368 |
| 1072907 | N/A | N/A | 4304 | 4323 | ATATGGACACAGGCTCAGAA | 79 | 1369 |
| 1072911 | N/A | N/A | 4463 | 4482 | CTGTGCAAGTCAAAGTAACT | 76 | 1370 |
| 1072915 | N/A | N/A | 4493 | 4512 | ATGAATTTTATTATGACCAC | 67 | 1371 |
| 1072919 | N/A | N/A | 4581 | 4600 | ACTTGAAGGCACACATGCAT | 70 | 1372 |
| 1072923 | N/A | N/A | 4648 | 4667 | CAGGCGCATCCACAAGCATA | 88 | 1373 |
| 1072927 | N/A | N/A | 4732 | 4751 | CTGGAGGATGAGCAGATGTG | 57 | 1374 |
| 1072931 | N/A | N/A | 4779 | 4798 | AGCAGCAGGAGGATTAAGGG | 68 | 1375 |
| 1072935 | N/A | N/A | 4827 | 4846 | TCCCTTGAGGCAGCTGTCAC | 96 | 1376 |
| 1072939 | N/A | N/A | 5058 | 5077 | GGAGCAGCACATTGCTCTGG | 80 | 1377 |
| 1072943 | N/A | N/A | 5299 | 5318 | TTGCAATCTCTGTGTTGAGC | 55 | 1378 |
| 1072947 | N/A | N/A | 5452 | 5471 | AGTTCGAATGCTCTCTTGTC | 78 | 1379 |
| 1072951 | N/A | N/A | 5715 | 5734 | ACCTTGGAGCGGTACCACTC | 111 | 1380 |
| 1072955 | N/A | N/A | 5828 | 5847 | TCAGTCACCTGGAGAGGATA | 58 | 138 |
| 1072959 | N/A | N/A | 5918 | 5937 | AGCAATAGTAGCAGTAATAA | 82 | 1382 |
| 1072963 | N/A | N/A | 5987 | 6006 | CTTCATAGTAAGGTAATCCA | 84 | 1383 |
| 1072967 | N/A | N/A | 6122 | 6141 | ATGGAATGCAGGCTCCCAAG | 71 | 1384 |
| 1072971 | N/A | N/A | 6251 | 6270 | TGTTCTCTACGGGCACTATG | 58 | 1385 |
| 1072975 | N/A | N/A | 6374 | 6393 | CCACTAGGAATGGCCCTCCC | 61 | 1386 |
| 1072979 | N/A | N/A | 6451 | 6470 | CTCAGCTAGGTGCCCTGGCT | 80 | 1387 |
| 1072983 | N/A | N/A | 6561 | 6580 | CCTCACCCTGGGTTCTAATA | 83 | 1388 |
| 1072987 | N/A | N/A | 6903 | 6922 | AGGCGAGCGGAGGCCTGGGT | 97 | 1389 |
| 1072991 | N/A | N/A | 6944 | 6963 | ACACTGACAGCTGCATCTGC | 79 | 1390 |
| 1072995 | N/A | N/A | 6997 | 7016 | CACCTGGTCAGCAAGCGAAT | 78 | 139 |
| 1072999 | N/A | N/A | 7082 | 7101 | GGCCCTGGCTGGGACTTTTC | 79 | 1392 |
| 1073003 | N/A | N/A | 7125 | 7144 | AAATCAGGGAGGTGAGCAGC | 46 | 1393 |
| 1073007 | N/A | N/A | 7382 | 7401 | CTTCTCCCCTGGCATCTCCT | 77 | 1394 |
| 1073011 | N/A | N/A | 7517 | 7536 | TGGAGOCGGCCGGTCCCGCG | 87 | 1395 |
| 1073015 | N/A | N/A | 7757 | 7776 | TGAGGGCTCACCGGTTCTCC | 81 | 1396 |

TABLE 19-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1073019 | N/A | N/A | 7789 | 7808 | AGGCAGCAGGGAGACTTCCC | 88 | 1397 |
| 1073023 | N/A | N/A | 7855 | 7874 | AAGGGATCTGCACACAAGGC | 79 | 1398 |
| 1073027 | N/A | N/A | 7924 | 7943 | TCAGTCATCAAACATCTAGT | 78 | 1399 |
| 1073031 | N/A | N/A | 8028 | 8047 | CCAATCTTGGCTGGGAAGAT | 66 | 1400 |
| 1073035 | N/A | N/A | 8051 | 8070 | AAGAGATGGGTGAGGTGAGG | 36 | 1401 |
| 1073039 | N/A | N/A | 8274 | 8293 | TAGGCTGGGTCTTGGTGCGG | 76 | 1402 |
| 1073043 | N/A | N/A | 9381 | 9400 | AAGTAATTTAGCTCCCCCCT | 76 | 1403 |
| 1073047 | N/A | N/A | 9411 | 9430 | AAGAATCATTTCAGGGCCAA | 54 | 1404 |
| 1073051 | N/A | N/A | 9440 | 9459 | CAGAAGAAGAGGAATTTTGT | 70 | 1405 |
| 1073055 | N/A | N/A | 9487 | 9506 | ATTAAGTCCTGAGACATGCA | 64 | 1406 |
| 1073059 | N/A | N/A | 9502 | 9521 | CCTTTCTGATGCTGAATTAA | 72 | 1407 |
| 1073063 | N/A | N/A | 9552 | 9571 | GTGACTATCTAGGATTTGGC | 23 | 1408 |
| 1073067 | N/A | N/A | 9685 | 9704 | GAGGAGACAATTAACTAAAA | 64 | 1409 |
| 1073071 | N/A | N/A | 10125 | 10144 | TCGAAAGCAGGCAAGCAAGC | 99 | 1410 |
| 1073075 | N/A | N/A | 10552 | 10571 | ATTGAAATCAGGAGACCAGG | 66 | 1411 |
| 1073079 | N/A | N/A | 10612 | 10631 | CATTTCAGCCCCTCTGCAAG | 77 | 1412 |
| 1073083 | N/A | N/A | 10724 | 10743 | CCTATGCAACCGAGCAGAGA | 95 | 1413 |
| 1073087 | N/A | N/A | 10848 | 10867 | GTGTCCAGGCTGGTTTCTGC | 82 | 1414 |
| 1073091 | N/A | N/A | 11124 | 11143 | ACCAAGGCTCCCCTTAGAAC | 59 | 1415 |
| 1073095 | N/A | N/A | 11166 | 11185 | AAAGAGAGAGTGTGTATTAG | 78 | 1416 |
| 1073099 | N/A | N/A | 11210 | 11229 | TCTTTCTCTCCCTGGCAAGC | 73 | 1417 |
| 1073103 | N/A | N/A | 11283 | 11302 | TGGAAATGGAAAGCCCTCCC | 78 | 1418 |
| 1073107 | N/A | N/A | 11391 | 11410 | GAGTGGTAAGCTGCTGGAGT | 42 | 1419 |
| 1073111 | N/A | N/A | 11474 | 11493 | TGATAGTAACCACAGCTGCC | 92 | 1420 |
| 1073115 | N/A | N/A | 11518 | 11537 | GTGTAACCTTGGGAAGTCCC | 77 | 1421 |

TABLE 20

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 7 | 517 |
| 1072812 | 1713 | 1732 | 12002 | 12021 | CAGTTTCCATAACAACAGGA | 58 | 1422 |
| 1072816 | 1722 | 1741 | 12011 | 12030 | CTCTGGCAACAGTTTCCATA | 69 | 1423 |
| 1072820 | 1749 | 1768 | 12038 | 12057 | TCCCAGATACTCCGAGAGAA | 73 | 1424 |

TABLE 20-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1072824 | 1758 | 1777 | 12047 | 12066 | AGGCACAGTTCCCAGATACT | 36 | 1425 |
| 1072828 | 1784 | 1803 | 12073 | 12092 | TCCTCCAGCAGCCTGAGGAA | 71 | 1426 |
| 1072832 | 1788 | 1807 | 12077 | 12096 | GTTTTCCTCCAGCAGCCTGA | 64 | 1427 |
| 1072836 | 2168 | 2187 | 12457 | 12476 | AAGCTCCCACCTGCCCACAG | 73 | 1428 |
| 1072840 | 2175 | 2194 | 12464 | 12483 | GAGAATCAAGCTCCCACCTG | 74 | 1429 |
| 1072844 | 3037 | 3056 | 13326 | 13345 | TTCCTCAGCGACTAAAGGCA | 61 | 1430 |
| 1072848 | 3042 | 3061 | 13331 | 13350 | TATTTTTCCTCAGCGACTAA | 69 | 1431 |
| 1072852 | 3063 | 3082 | 13352 | 13371 | GAAGGGCGCAGCATTTGTCT | 57 | 1432 |
| 1072856 | N/A | N/A | 8772 | 8791 | TGAGATATCTTGTGACCTTG | 43 | 1433 |
| 1072860 | N/A | N/A | 8776 | 8795 | CTTTTGAGATATCTTGTGAC | 62 | 1434 |
| 1072864 | N/A | N/A | 8783 | 8802 | TGTGAGGCTTTTGAGATATC | 43 | 1435 |
| 1072868 | N/A | N/A | 8788 | 8807 | CGTATTGTGAGGCTTTTGAG | 20 | 1436 |
| 1072872 | N/A | N/A | 7984 | 8003 | GGGTGACCCAAGTCCTTGGC | 14 | 1437 |
| 1072876 | N/A | N/A | 7992 | 8011 | AGTTTGGAGGGTGACCCAAG | 61 | 1438 |
| 1072880 | N/A | N/A | 11293 | 11312 | TTTACCAAGCTGGAAATGGA | 83 | 1439 |
| 1072884 | N/A | N/A | 11298 | 11317 | TTCCTTTTACCAAGCTGGAA | 77 | 1440 |
| 1072888 | N/A | N/A | 11310 | 11329 | TCCCCTGGTAGTTTCCTTTT | 85 | 1441 |
| 1072892 | N/A | N/A | 4055 | 4074 | CAGGGAGGTTCGGCCCCTCC | 83 | 1442 |
| 1072896 | N/A | N/A | 4174 | 4193 | CTCCTGGCAGAAGGCATGCG | 75 | 1443 |
| 1072900 | N/A | N/A | 4231 | 4250 | GGCCCCGCTGCTCCTGCACT | 105 | 1444 |
| 1072904 | N/A | N/A | 4289 | 4308 | CAGAATAGGTGAGCTCGCTG | 83 | 1445 |
| 1072908 | N/A | N/A | 4307 | 4326 | TTTATATGGACACAGGCTCA | 83 | 1446 |
| 1072912 | N/A | N/A | 4482 | 4501 | TATGACCACCGCTTCACAGC | 95 | 1447 |
| 1072916 | N/A | N/A | 4558 | 4577 | CTGTCAGCTCAGTGAAGCGC | 86 | 1448 |
| 1072920 | N/A | N/A | 4628 | 4647 | CACTCACTGTTGCACACACA | 89 | 1449 |
| 1072924 | N/A | N/A | 4651 | 4670 | ACACAGGCGCATCCACAAGC | 98 | 1450 |
| 1072928 | N/A | N/A | 4739 | 4758 | GACTTGTCTGGAGGATGAGC | 73 | 1451 |
| 1072932 | N/A | N/A | 4785 | 4804 | CAGTAGAGCAGCAGGAGGAT | 82 | 1452 |
| 1072936 | N/A | N/A | 4882 | 4901 | GGACACATTCCTGGGTCCAG | 100 | 1453 |
| 1072940 | N/A | N/A | 5142 | 5161 | GGTGAGGAGTAGAGGGCCAC | 88 | 1454 |
| 1072944 | N/A | N/A | 5307 | 5326 | TCTCTCAGTTGCAATCTCTG | 84 | 1455 |
| 1072948 | N/A | N/A | 5453 | 5472 | GAGTTCGAATGCTCTCTTGT | 75 | 1456 |
| 1072952 | N/A | N/A | 5730 | 5749 | CCCACAGGCAGGGCTACCTT | 89 | 1457 |
| 1072956 | N/A | N/A | 5891 | 5910 | TACTTTTGAAAGCAATAGTG | 77 | 1458 |
| 1072960 | N/A | N/A | 5953 | 5972 | CTTAGAACAGAACAGTATCA | 101 | 1459 |
| 1072964 | N/A | N/A | 6028 | 6047 | TCTGGACTTCGGCTCTCTCA | 55 | 1460 |
| 1072968 | N/A | N/A | 6140 | 6159 | AAACAGACTGGCAGAGGCAT | 59 | 1461 |

TABLE 20-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1072972 | N/A | N/A | 6260 | 6279 | GAGCTGTGGTGTTCTCTACG | 58 | 1462 |
| 1072976 | N/A | N/A | 6380 | 6399 | TGTCCTCCACTAGGAATGGC | 76 | 1463 |
| 1072980 | N/A | N/A | 6459 | 6478 | TCACACTCCTCAGCTAGGTG | 32 | 1464 |
| 1072984 | N/A | N/A | 6563 | 6582 | GGCCTCACCCTGGGTTCTAA | 76 | 1465 |
| 1072988 | N/A | N/A | 6905 | 6924 | TTAGGCGAGCGGAGGCCTGG | 95 | 1466 |
| 1072992 | N/A | N/A | 6945 | 6964 | CACACTGACAGCTGCATCTG | 90 | 1467 |
| 1072996 | N/A | N/A | 7003 | 7022 | GCACAACACCTGGTCAGCAA | 73 | 1468 |
| 1073000 | N/A | N/A | 7085 | 7104 | GTTGGCCCTGGCTGGGACTT | 63 | 1469 |
| 1073004 | N/A | N/A | 7126 | 7145 | GAAATCAGGGAGGTGAGCAG | 63 | 1470 |
| 1073008 | N/A | N/A | 7475 | 7494 | GGTTTCGAGGCCCGGCCCCC | 73 | 1471 |
| 1073012 | N/A | N/A | 7518 | 7537 | ATGGAGCCGGCCGGTCCCGC | 92 | 1472 |
| 1073016 | N/A | N/A | 7762 | 7781 | TGTGATGAGGGCTCACCGGT | 65 | 1473 |
| 1073020 | N/A | N/A | 7797 | 7816 | CTACCGTGAGGCAGCAGGGA | 86 | 1474 |
| 1073024 | N/A | N/A | 7876 | 7895 | TGTGCTGGGCATTGAGGTGG | 64 | 1475 |
| 1073028 | N/A | N/A | 7967 | 7986 | GGCCTTGAGGCCTAATCAAT | 78 | 1476 |
| 1073032 | N/A | N/A | 8045 | 8064 | TGGGTGAGGTGAGGAGTCCA | 73 | 1477 |
| 1073036 | N/A | N/A | 8057 | 8076 | AGGCAGAAGAGATGGGTGAG | 67 | 1478 |
| 1073040 | N/A | N/A | 9355 | 9374 | GCCCCGCCCGAGAGAGAAAA | 92 | 1479 |
| 1073044 | N/A | N/A | 9407 | 9426 | ATCATTTCAGGGCCAATGCA | 66 | 1480 |
| 1073048 | N/A | N/A | 9423 | 9442 | TGTTCCTTAGCTAAGAATCA | 58 | 1481 |
| 1073052 | N/A | N/A | 9442 | 9461 | TCCAGAAGAAGAGGAATTTT | 94 | 1482 |
| 1073056 | N/A | N/A | 9488 | 9507 | AATTAAGTCCTGAGACATGC | 51 | 1483 |
| 1073060 | N/A | N/A | 9517 | 9536 | AGTCAGCCTGGTTAGCCTTT | 36 | 1484 |
| 1073064 | N/A | N/A | 9560 | 9579 | AGTGACCTGTGACTATCTAG | 35 | 1485 |
| 1073068 | N/A | N/A | 9889 | 9908 | TCTGCCGAAGGAAGGAAGGA | 77 | 1486 |
| 1073072 | N/A | N/A | 10129 | 10148 | TCCGTCGAAAGCAGGCAAGC | 83 | 1487 |
| 1073076 | N/A | N/A | 10555 | 10574 | GGTATTGAAATCAGGAGACC | 59 | 1488 |
| 1073080 | N/A | N/A | 10662 | 10681 | CAATAGTGCTGCTGCCAGAG | 54 | 1489 |
| 1073084 | N/A | N/A | 10727 | 10746 | GAACCTATGCAACCGAGCAG | 56 | 1490 |
| 1073088 | N/A | N/A | 11008 | 11027 | TATGTGCCAGCCCCAGGCTT | 89 | 1491 |
| 1073092 | N/A | N/A | 11128 | 11147 | TGGTACCAAGGCTCCCCTTA | 74 | 1492 |
| 1073096 | N/A | N/A | 11187 | 11206 | GCCCCCGAGTTTGAGGGTGA | 90 | 1493 |
| 1073100 | N/A | N/A | 11240 | 11259 | GTTGGAAGTGAAAGCTACTA | 58 | 1494 |
| 1073104 | N/A | N/A | 11365 | 11384 | AGCTCCCACTGTGGTTGGAG | 87 | 1495 |

TABLE 20-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1073108 | N/A | N/A | 11399 | 11418 | TGCCTGGCGAGTGGTAAGCT | 91 | 1496 |
| 1073112 | N/A | N/A | 11476 | 11495 | CTTGATAGTAACCACAGCTG | 63 | 1497 |
| 1073116 | N/A | N/A | 11561 | 11580 | AGTTAGGAGTTCACACAGAC | 72 | 1498 |

TABLE 21

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 8 | 517 |
| 1072813 | 1717 | 1736 | 12006 | 12025 | GCAACAGTTTCCATAACAAC | 32 | 1499 |
| 1072817 | 1725 | 1744 | 12014 | 12033 | CATCTCTGGCAACAGTTTCC | 62 | 1500 |
| 1072821 | 1751 | 1770 | 12040 | 12059 | GTTCCCAGATACTCCGAGAG | 53 | 1501 |
| 1072825 | 1759 | 1778 | 12048 | 12067 | AAGGCACAGTTCCCAGATAC | 51 | 1502 |
| 1072829 | 1785 | 1804 | 12074 | 12093 | TTCCTCCAGCAGCCTGAGGA | 89 | 1503 |
| 1072833 | 1789 | 1808 | 12078 | 12097 | AGTTTTCCTCCAGCAGCCTG | 46 | 1504 |
| 1072837 | 2171 | 2190 | 12460 | 12479 | ATCAAGCTCCCACCTGCCCA | 64 | 1505 |
| 1072841 | 2176 | 2195 | 12465 | 12484 | TGAGAATCAAGCTCCCACCT | 90 | 1506 |
| 1072845 | 3038 | 3057 | 13327 | 13346 | TTTCCTCAGCGACTAAAGGC | 52 | 1507 |
| 1072849 | 3057 | 3076 | 13346 | 13365 | CGCAGCATTTGTCTTTATTT | 26 | 1508 |
| 1072853 | 3064 | 3083 | 13353 | 13372 | GGAAGGGCGCAGCATTTGTC | 43 | 1509 |
| 1072857 | N/A | N/A | 8773 | 8792 | TTGAGATATCTTGTGACCTT | 32 | 1510 |
| 1072861 | N/A | N/A | 8779 | 8798 | AGGCTTTTGAGATATCTTGT | 35 | 1511 |
| 1072865 | N/A | N/A | 8784 | 8803 | TTGTGAGGCTTTTGAGATAT | 47 | 1512 |
| 1072869 | N/A | N/A | 7977 | 7996 | CCAAGTCCTTGGCCTTGAGG | 93 | 1513 |
| 1072873 | N/A | N/A | 7988 | 8007 | TGGAGGGTGACCCAAGTCCT | 107 | 1514 |
| 1072877 | N/A | N/A | 7994 | 8013 | TTAGTTTGGAGGGTGACCCA | 68 | 1515 |
| 1072881 | N/A | N/A | 11295 | 11314 | CTTTTACCAAGCTGGAAATG | 103 | 1516 |
| 1072885 | N/A | N/A | 11299 | 11318 | TTTCCTTTTACCAAGCTGGA | 80 | 1517 |
| 1072889 | N/A | N/A | 4027 | 4046 | TCTCGGGCACTCCTTCTTGG | 96 | 1518 |
| 1072893 | N/A | N/A | 4084 | 4103 | CCCATCAAGAGGTAGGGAGG | 66 | 1519 |
| 1072897 | N/A | N/A | 4183 | 4202 | GACCCTGGACTCCTGGCAGA | 83 | 1520 |
| 1072901 | N/A | N/A | 4253 | 4272 | CCAGCCATGAATGAAACACA | 82 | 1521 |
| 1072905 | N/A | N/A | 4293 | 4312 | GGCTCAGAATAGGTGAGCTC | 67 | 1522 |
| 1072909 | N/A | N/A | 4435 | 4454 | GTCACAAGCTGGTGGCAGGC | 69 | 1523 |
| 1072913 | N/A | N/A | 4487 | 4506 | TTTATTATGACCACCGCTTC | 92 | 1524 |
| 1072917 | N/A | N/A | 4563 | 4582 | ATGTCCTGTCAGCTCAGTGA | 50 | 1525 |

TABLE 21-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1072921 | N/A | N/A | 4632 | 4651 | CATACACTCACTGTTGCACA | 83 | 1526 |
| 1072925 | N/A | N/A | 4669 | 4688 | GTGCACCTGCTTCTGCTCAC | 111 | 1527 |
| 1072929 | N/A | N/A | 4741 | 4760 | AGGACTTGTCTGGAGGATGA | 47 | 1528 |
| 1072933 | N/A | N/A | 4822 | 4841 | TGAGGCAGCTGTCACAGAGA | 102 | 1529 |
| 1072937 | N/A | N/A | 4904 | 4923 | CATCCTGGAGCCTGGAGTGG | 87 | 1530 |
| 1072941 | N/A | N/A | 5295 | 5314 | AATCTCTGTGTTGAGCTTTC | 56 | 1531 |
| 1072945 | N/A | N/A | 5308 | 5327 | CTCTCTCAGTTGCAATCTCT | 75 | 1532 |
| 1072949 | N/A | N/A | 5460 | 5479 | CGGCCAGGAGTTCGAATGCT | 81 | 1533 |
| 1072953 | N/A | N/A | 5733 | 5752 | TGGCCCACAGGCAGGGCTAC | 83 | 1534 |
| 1072957 | N/A | N/A | 5895 | 5914 | TGGGTACTTTTGAAAGCAAT | 75 | 1535 |
| 1072961 | N/A | N/A | 5965 | 5984 | AAAAGCACAGGGCTTAGAAC | 76 | 1536 |
| 1072965 | N/A | N/A | 6031 | 6050 | CTCTCTGGACTTCGGCTCTC | 88 | 1537 |
| 1072969 | N/A | N/A | 6167 | 6186 | GGCATATGGTAGAGGCTCAG | 56 | 1538 |
| 1072973 | N/A | N/A | 6270 | 6289 | TATAAGCTCTGAGCTGTGGT | 37 | 1539 |
| 1072977 | N/A | N/A | 6443 | 6462 | GGTGCCCTGGCTAGGCTAGC | 77 | 1540 |
| 1072981 | N/A | N/A | 6460 | 6479 | CTCACACTCCTCAGCTAGGT | 77 | 1541 |
| 1072985 | N/A | N/A | 6897 | 6916 | GCGGAGGCCTGGGTGTTTTG | 75 | 1542 |
| 1072989 | N/A | N/A | 6908 | 6927 | GTCTTAGGCGAGCGGAGGCC | 90 | 1543 |
| 1072993 | N/A | N/A | 6972 | 6991 | AACAGTGCCACAGAATCCAG | 91 | 1544 |
| 1072997 | N/A | N/A | 7051 | 7070 | GACCCATGGATGCGGGCAGG | 68 | 1545 |
| 1073001 | N/A | N/A | 7086 | 7105 | CGTTGGCCCTGGCTGGGACT | 71 | 1546 |
| 1073005 | N/A | N/A | 7201 | 7220 | TCTGTCAGGTCTGCAAACTA | 83 | 1547 |
| 1073009 | N/A | N/A | 7479 | 7498 | GGGAGGTTTCGAGGCCCGGC | 41 | 1548 |
| 1073013 | N/A | N/A | 7520 | 7539 | GGATGGAGCCGGCCGGTCCC | 81 | 1549 |
| 1073017 | N/A | N/A | 7764 | 7783 | GCTGTGATGAGGGCTCACCG | 68 | 1550 |
| 1073021 | N/A | N/A | 7818 | 7837 | CTGAAGGGAGCAAGATGAGC | 82 | 1551 |
| 1073025 | N/A | N/A | 7878 | 7897 | ACTGTGCTGGGCATTGAGGT | 77 | 1552 |
| 1073029 | N/A | N/A | 8005 | 8024 | GAGTATGCCTCTTAGTTTGG | 63 | 1553 |
| 1073033 | N/A | N/A | 8046 | 8065 | ATGGGTGAGGTGAGGAGTCC | 36 | 1554 |
| 1073037 | N/A | N/A | 8078 | 8097 | GTGGTGAAGAAAGTTCCAAG | 88 | 1555 |
| 1073041 | N/A | N/A | 9356 | 9375 | CGCCCCGCCCGAGAGAGAAA | 64 | 1556 |
| 1073045 | N/A | N/A | 9409 | 9428 | GAATCATTTCAGGGCCAATG | 27 | 1557 |
| 1073049 | N/A | N/A | 9425 | 9444 | TTTGTTCCTTAGCTAAGAAT | 62 | 1558 |
| 1073053 | N/A | N/A | 9444 | 9463 | AGTCCAGAAGAAGAGGAATT | 68 | 1559 |
| 1073057 | N/A | N/A | 9497 | 9516 | CTGATGCTGAATTAAGTCCT | 50 | 1560 |
| 1073061 | N/A | N/A | 9519 | 9538 | CTAGTCAGCCTGGTTAGCCT | 57 | 1561 |

TABLE 21-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1073065 | N/A | N/A | 9577 | 9596 | CCATTTATCTGTGCTTTAGT | 39 | 1562 |
| 1073069 | N/A | N/A | 9892 | 9911 | CGCTCTGCCGAAGGAAGGAA | 61 | 1563 |
| 1073073 | N/A | N/A | 10548 | 10567 | AAATCAGGAGACCAGGAGGG | 59 | 1564 |
| 1073077 | N/A | N/A | 10561 | 10580 | CAGCACGGTATTGAAATCAG | 42 | 1565 |
| 1073081 | N/A | N/A | 10692 | 10711 | TTCCAAACGGGCTGGAGAGC | 84 | 1566 |
| 1073085 | N/A | N/A | 10804 | 10823 | ATGGACTTTCAGGGCATGAG | 64 | 1567 |
| 1073089 | N/A | N/A | 11097 | 11116 | GGAGGGACTGAGGAAACGGA | 68 | 1568 |
| 1073093 | N/A | N/A | 11157 | 11176 | GTGTGTATTAGGATCCCATC | 24 | 1569 |
| 1073097 | N/A | N/A | 11193 | 11212 | AGCAAGGCCCCCGAGTTTGA | 81 | 1570 |
| 1073101 | N/A | N/A | 11246 | 11265 | GCTAGAGTTGGAAGTGAAAG | 67 | 1571 |
| 1073105 | N/A | N/A | 11368 | 11387 | ATGAGCTCCCACTGTGGTTG | 72 | 1572 |
| 1073109 | N/A | N/A | 11427 | 11446 | GATAACACTGGGAAAGCATT | 91 | 1573 |
| 1073113 | N/A | N/A | 11514 | 11533 | AACCTTGGGAAGTCCCCGAC | 85 | 1574 |
| 1073117 | N/A | N/A | 11563 | 11582 | ACAGTTAGGAGTTCACACAG | 75 | 1575 |

TABLE 22

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 5 | 517 |
| 1103152 | 41 | 60 | 3489 | 3508 | CTGGCTCTGCTCGCTCCTGG | 91 | 1576 |
| 1103168 | 272 | 291 | 3720 | 3739 | CTCCATCATCTCTGCCCGCT | 106 | 1577 |
| 1103184 | 565 | 584 | 4950 | 4969 | CTATAGGCAGCCAGGTTGTT | 69* | 1578 |
| 1103200 | 760 | 779 | 5646 | 5665 | ATCTCTTTCAGGGCTGCGGT | 65 | 1579 |
| 1103216 | 1062 | 1081 | 7634 | 7653 | TGAGGCTCTGCCCCTCTTCC | 111 | 1580 |
| 1103232 | 1335 | 1354 | 11624 | 11643 | CCTTGTGCTCCTGCTTGGAC | 88 | 1581 |
| 1103248 | 1527 | 1546 | 11816 | 11835 | AGGCCTGATACTGACGGAGC | 79 | 1582 |
| 1103264 | 1669 | 1688 | 11958 | 11977 | GTAGGTGCCCCCCGCCCTCC | 90 | 1583 |
| 1103280 | 1733 | 1752 | 12022 | 12041 | AGAACCTCCATCTCTGGCAA | 62 | 1584 |
| 1103296 | 1860 | 1879 | 12149 | 12168 | CCAAAAGACAAAACAAGCCT | 75 | 1585 |
| 1103312 | 1886 | 1905 | 12175 | 12194 | CATAGGGATATCCCACCTCA | 111 | 1586 |
| 1103328 | 2094 | 2113 | 12383 | 12402 | GTCATCGCTCAGGAGGTCCT | 69 | 1587 |
| 1103344 | 2231 | 2250 | 12520 | 12539 | CTATCCCTCCCAGCACCTCA | 109 | 1588 |
| 1103360 | 2427 | 2446 | 12716 | 12735 | AGGATGAGTCACTTCCTTAA | 73 | 1589 |
| 1103376 | 2484 | 2503 | 12773 | 12792 | GTCATGCCCTGCCCCCATGG | 90 | 1590 |
| 1103392 | 2512 | 2531 | 12801 | 12820 | AGGAAGAGGCCTTTAGAAAT | 68 | 1591 |

TABLE 22-continued

| Reduction of GFAP RNA by 5-10-5 MCE gapmers with mixed PO/PS internucleoside linkages in U251 cells | | | | | | | |
|---|---|---|---|---|---|---|---|
| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
| 1103408 | 2672 | 2691 | 12961 | 12980 | GTGTGTGAGTAAGAAGGGAC | 55 | 1592 |
| 1103424 | 2724 | 2743 | 13013 | 13032 | TCAGTTTTACAATTGTAAAA | 83 | 1593 |
| 1103440 | 2899 | 2918 | 13188 | 13207 | GGAGAACCCTGAAGTGGGCC | 76 | 1594 |
| 1103472 | N/A | N/A | 8787 | 8806 | GTATTGTGAGGCTTTTGAGA | 43 | 1595 |
| 1103488 | N/A | N/A | 8899 | 8918 | GAGGCTCACTCCCTGTCAAG | 60 | 1596 |
| 1103504 | N/A | N/A | 9045 | 9064 | AACAAGCTCTGCCAGTTTAA | 66 | 1597 |
| 1103520 | N/A | N/A | 9234 | 9253 | TGAGTCAGCACTGAGCTGAG | 95 | 1598 |
| 1103536 | N/A | N/A | 9270 | 9289 | CAAGAGCTGCGGTCCTGAGG | 59 | 1599 |
| 1103552 | N/A | N/A | 9310 | 9329 | TTTAACATTAAGAGCAGGGA | 63 | 1600 |
| 1103568 | N/A | N/A | 8532 | 8551 | CTGGTATGATAGGCTCTGGC | 86 | 1601 |
| 1103584 | N/A | N/A | 8650 | 8669 | CAGACAGGGCAGATGTCAAG | 92 | 1602 |
| 1103600 | N/A | N/A | 3999 | 4018 | CCCCTTCTGCTCACAAGGCC | 121 | 1603 |
| 1103616 | N/A | N/A | 4160 | 4179 | CATGCGGGCATCAGATCCCC | 89 | 1604 |
| 1103632 | N/A | N/A | 4275 | 4294 | TCGCTGCCCACAGTCACAAA | 104 | 1605 |
| 1103648 | N/A | N/A | 4407 | 4426 | GTGCTTTGCGCCCAGACCTG | 105 | 1606 |
| 1103664 | N/A | N/A | 4496 | 4515 | GAAATGAATTTTATTATGAC | 106 | 1607 |
| 1103680 | N/A | N/A | 4640 | 4659 | TCCACAAGCATACACTCACT | 81 | 1608 |
| 1103696 | N/A | N/A | 4837 | 4856 | TGCCTCAGTCTCCCTTGAGG | 107 | 1609 |
| 1103712 | N/A | N/A | 5100 | 5119 | CCATTCCTCAGCCTTGCCTT | 98 | 1610 |
| 1103728 | N/A | N/A | 5346 | 5365 | GTCTCTCTCAGTCTCAGCTT | 78 | 1611 |
| 1103744 | N/A | N/A | 5413 | 5432 | GTCTTTCTGTTTGTCTTTCA | 57 | 1612 |
| 1103760 | N/A | N/A | 5487 | 5506 | CCATTGTGTCCTCTTCTGCC | 102 | 1613 |
| 1103776 | N/A | N/A | 5776 | 5795 | TTCTCTTGTACAGAGCAAGA | 79 | 1614 |
| 1103792 | N/A | N/A | 5860 | 5879 | CTGGGCAAGCCATCTCACTT | 86 | 1615 |
| 1103808 | N/A | N/A | 5941 | 5960 | CAGTATCAGCTACTACTAAT | 80 | 1616 |
| 1103824 | N/A | N/A | 5978 | 5997 | AAGGTAATCCATGAAAAGCA | 84 | 1617 |
| 1103840 | N/A | N/A | 6024 | 6043 | GACTTCGGCTCTCTCATCTG | 82 | 1618 |
| 1103856 | N/A | N/A | 6204 | 6223 | CCAGGTCAGACACCTCTCTG | 81 | 1619 |
| 1103872 | N/A | N/A | 6267 | 6286 | AAGCTCTGAGCTGTGGTGTT | 33 | 1620 |
| 1103888 | N/A | N/A | 6315 | 6334 | CCCAAATGCCCCCTCTACAG | 93 | 1621 |
| 1103904 | N/A | N/A | 6414 | 6433 | CCCTGCCTCTCTGTGCTTTT | 92 | 1622 |
| 1103920 | N/A | N/A | 6517 | 6536 | AGGTCCTCCCAGCCCCATCG | 108 | 1623 |
| 1103936 | N/A | N/A | 6947 | 6966 | TCCACACTGACAGCTGCATC | 92 | 1624 |
| 1103952 | N/A | N/A | 7030 | 7049 | TAGCGGGCTGCCAGACCTCA | 102 | 1625 |
| 1103968 | N/A | N/A | 7326 | 7345 | CCCTGGCCGCGCTCACCGTG | 96 | 1626 |
| 1103984 | N/A | N/A | 7421 | 7440 | TTCAGGCCCCGCCCTCGACC | 81 | 1627 |

TABLE 22-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104000 | N/A | N/A | 7814 | 7833 | AGGGAGCAAGATGAGCTCTA | 120 | 1628 |
| 1104016 | N/A | N/A | 7940 | 7959 | GAATCCATCCATCCATTCAG | 86 | 1629 |
| 1104032 | N/A | N/A | 8038 | 8057 | GGTGAGGAGTCCAATCTTGG | 76 | 1630 |
| 1104048 | N/A | N/A | 8080 | 8099 | AAGTGGTGAAGAAAGTTCCA | 108 | 1631 |
| 1104064 | N/A | N/A | 8251 | 8270 | CATCATGACAACTTGAACGC | 98 | 1632 |
| 1104080 | N/A | N/A | 9364 | 9383 | CCTCCCCCCGCCCCGCCCGA | 111 | 1633 |
| 1104096 | N/A | N/A | 9414 | 9433 | GCTAAGAATCATTTCAGGGC | 40 | 1634 |
| 1104112 | N/A | N/A | 9455 | 9474 | CTAAATATTCTAGTCCAGAA | 97 | 1635 |
| 1104128 | N/A | N/A | 9509 | 9528 | TGGTTAGCCTTTCTGATGCT | 84 | 1636 |
| 1104144 | N/A | N/A | 9535 | 9554 | GGCAGTATTACCTCTACTAG | 28 | 1637 |
| 1104160 | N/A | N/A | 9559 | 9578 | GTGACCTGTGACTATCTAGG | 47 | 1638 |
| 1104176 | N/A | N/A | 9579 | 9598 | TGCCATTTATCTGTGCTTTA | 50 | 1639 |
| 1104192 | N/A | N/A | 9665 | 9684 | TAAAGGCTGTTAAACATGTG | 51 | 1640 |
| 1104208 | N/A | N/A | 9785 | 9804 | ACCAGCCACATGACTCTGGG | 83 | 1641 |
| 1104224 | N/A | N/A | 10558 | 10577 | CACGGTATTGAAATCAGGAG | 47 | 1642 |
| 1104240 | N/A | N/A | 10654 | 10673 | CTGCTGCCAGAGTCCTGGCT | 88 | 1643 |
| 1104256 | N/A | N/A | 10753 | 10772 | CACCCCCCTCCCCATCATGA | 89 | 1644 |
| 1104272 | N/A | N/A | 10818 | 10837 | AGAGGAGGCCTCTCATGGAC | 96 | 1645 |
| 1104288 | N/A | N/A | 11083 | 11102 | AACGGAATTACATTCAGTTT | 81 | 1646 |
| 1104304 | N/A | N/A | 11152 | 11171 | TATTAGGATCCCATCTAGTG | 103 | 1647 |
| 1104320 | N/A | N/A | 11230 | 11249 | AAAGCTACTAACTTTAATTC | 81 | 1648 |
| 1104336 | N/A | N/A | 11288 | 11307 | CAAGCTGGAAATGGAAAGCC | 83 | 1649 |
| 1104352 | N/A | N/A | 11390 | 11409 | AGTGGTAAGCTGCTGGAGTA | 85 | 1650 |
| 1104368 | N/A | N/A | 11499 | 11518 | CCGACTTCCCAGGTCTTACT | 78 | 1651 |

TABLE 23

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 6 | 517 |
| 1103150 | 20 | 39 | 3468 | 3487 | ATGCGAGGGCTTTATGAAGG | 82 | 1652 |
| 1103166 | 264 | 283 | 3712 | 3731 | TCTCTGCCCGCTCACTGGCC | 126 | 1653 |
| 1103182 | 549 | 568 | 4934 | 4953 | TGTTCTCGGCTTCCAGCCTC | 40* | 1654 |
| 1103198 | 758 | 777 | 5644 | 5663 | CTCTTTCAGGGCTGCGGTGA | 35 | 1655 |
| 1103214 | 1049 | 1068 | 7621 | 7640 | CTCTTCCTCCAGCCGCGCCA | 70 | 1656 |
| 1103230 | 1327 | 1346 | 11616 | 11635 | TCCTGCTTGGACTCCTTAAT | 69 | 1657 |

TABLE 23-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103246 | 1501 | 1520 | 11790 | 11809 | CAGCAAGCTGACCTAGGGAC | 39 | 1658 |
| 1103262 | 1662 | 1681 | 11951 | 11970 | CCCCCCGCCCTCCTCCCCTT | 91 | 1659 |
| 1103278 | 1729 | 1748 | 12018 | 12037 | CCTCCATCTCTGGCAACAGT | 34 | 1660 |
| 1103294 | 1858 | 1877 | 12147 | 12166 | AAAAGACAAAACAAGCCTCT | 81 | 1661 |
| 1103310 | 1884 | 1903 | 12173 | 12192 | TAGGGATATCCCACCTCATA | 74 | 1662 |
| 1103326 | 2061 | 2080 | 12350 | 12369 | CAGGTGACTGCCCCAGGTGG | 73 | 1663 |
| 1103342 | 2228 | 2247 | 12517 | 12536 | TCCCTCCCAGCACCTCATCC | 80 | 1664 |
| 1103358 | 2424 | 2443 | 12713 | 12732 | ATGAGTCACTTCCTTAATTC | 58 | 1665 |
| 1103374 | 2467 | 2486 | 12756 | 12775 | TGGATACATCCCCTTTCTCT | 59 | 1666 |
| 1103390 | 2510 | 2529 | 12799 | 12818 | GAAGAGGCCTTTAGAAATGG | 76 | 1667 |
| 1103406 | 2668 | 2687 | 12957 | 12976 | GTGAGTAAGAAGGGACCGCA | 82 | 1668 |
| 1103422 | 2717 | 2736 | 13006 | 13025 | TACAATTGTAAAATAGGGCA | 90 | 1669 |
| 1103438 | 2849 | 2868 | 13138 | 13157 | ACCAGTCTGCTCACCAGTCT | 74 | 1670 |
| 1103470 | N/A | N/A | 8769 | 8788 | GATATCTTGTGACCTTGTGA | 34 | 1671 |
| 1103486 | N/A | N/A | 8897 | 8916 | GGCTCACTCCCTGTCAAGCT | 100 | 1672 |
| 1103502 | N/A | N/A | 9043 | 9062 | CAAGCTCTGCCAGTTTAATG | 30 | 1673 |
| 1103518 | N/A | N/A | 9224 | 9243 | CTGAGCTGAGCGATGGAGCC | 71 | 1674 |
| 1103534 | N/A | N/A | 9263 | 9282 | TGCGGTCCTGAGGGAAGAAT | 76 | 1675 |
| 1103550 | N/A | N/A | 9308 | 9327 | TAACATTAAGAGCAGGGAAC | 77 | 1676 |
| 1103566 | N/A | N/A | 8500 | 8519 | AGTGTCACGAAGGCCCCCAG | 49 | 1677 |
| 1103582 | N/A | N/A | 8584 | 8603 | GGACCAGGGCCTAGCAGGAC | 69 | 1678 |
| 1103598 | N/A | N/A | 3993 | 4012 | CTGCTCACAAGGCCCCCCTT | 92 | 1679 |
| 1103614 | N/A | N/A | 4049 | 4068 | GGTTCGGCCCCTCCCTGAGA | 69 | 1680 |
| 1103630 | N/A | N/A | 4250 | 4269 | GCCATGAATGAAACACAGGG | 66 | 1681 |
| 1103646 | N/A | N/A | 4391 | 4410 | CCTGCCTGCTCTTTCCCTCA | 76 | 1682 |
| 1103662 | N/A | N/A | 4490 | 4509 | AATTTTATTATGACCACCGC | 110 | 1683 |
| 1103678 | N/A | N/A | 4635 | 4654 | AAGCATACACTCACTGTTGC | 78 | 1684 |
| 1103694 | N/A | N/A | 4817 | 4836 | CAGCTGTCACAGAGACCACC | 100 | 1685 |
| 1103710 | N/A | N/A | 5097 | 5116 | TTCCTCAGCCTTGCCTTACC | 78 | 1686 |
| 1103726 | N/A | N/A | 5305 | 5324 | TCTCAGTTGCAATCTCTGTG | 87 | 1687 |
| 1103742 | N/A | N/A | 5398 | 5417 | TTTCATTTCCTGTCTCTACC | 89 | 1688 |
| 1103758 | N/A | N/A | 5481 | 5500 | TGTCCTCTTCTGCCTGCCCC | 94 | 1689 |
| 1103774 | N/A | N/A | 5726 | 5745 | CAGGCAGGGCTACCTTGGAG | 87 | 1690 |
| 1103790 | N/A | N/A | 5849 | 5868 | ATCTCACTTCTCTGGTGAAA | 95 | 1691 |
| 1103806 | N/A | N/A | 5923 | 5942 | ATAATAGCAATAGTAGCAGT | 103 | 1692 |
| 1103822 | N/A | N/A | 5974 | 5993 | TAATCCATGAAAAGCACAGG | 84 | 1693 |

TABLE 23-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103838 | N/A | N/A | 6020 | 6039 | TCGGCTCTCTCATCTGTCAA | 53 | 1694 |
| 1103854 | N/A | N/A | 6199 | 6218 | TCAGACACCTCTCTGTGTCC | 86 | 1695 |
| 1103870 | N/A | N/A | 6257 | 6276 | CTGTGGTGTTCTCTACGGGC | 78 | 1696 |
| 1103886 | N/A | N/A | 6313 | 6332 | CAAATGCCCCCTCTACAGTG | 105 | 1697 |
| 1103902 | N/A | N/A | 6408 | 6427 | CTCTCTGTGCTTTTCTGCCT | 71 | 1698 |
| 1103918 | N/A | N/A | 6501 | 6520 | ATCGGGCCCTCACCCTGCTC | 107 | 1699 |
| 1103934 | N/A | N/A | 6904 | 6923 | TAGGCGAGCGGAGGCCTGGG | 90 | 1700 |
| 1103950 | N/A | N/A | 7017 | 7036 | GACCTCAGCACCTAGCACAA | 82 | 1701 |
| 1103966 | N/A | N/A | 7314 | 7333 | TCACCGTGCCGCGCAGAGAC | 101 | 1702 |
| 1103982 | N/A | N/A | 7416 | 7435 | GCCCCGCCCTCGACCCAGGT | 88 | 1703 |
| 1103998 | N/A | N/A | 7805 | 7824 | GATGAGCTCTACCGTGAGGC | 71 | 1704 |
| 1104014 | N/A | N/A | 7922 | 7941 | AGTCATCAAACATCTAGTGA | 46 | 1705 |
| 1104030 | N/A | N/A | 8035 | 8054 | GAGGAGTCCAATCTTGGCTG | 67 | 1706 |
| 1104046 | N/A | N/A | 8075 | 8094 | GTGAAGAAAGTTCCAAGGAG | 93 | 1707 |
| 1104062 | N/A | N/A | 8228 | 8247 | TTTCCTTGCCAGGAAAGTCT | 81 | 1708 |
| 1104078 | N/A | N/A | 9359 | 9378 | CCCCGCCCCGCCCGAGAGAG | 36 | 1709 |
| 1104094 | N/A | N/A | 9412 | 9431 | TAAGAATCATTTCAGGGCCA | 71 | 1710 |
| 1104110 | N/A | N/A | 9452 | 9471 | AATATTCTAGTCCAGAAGAA | 103 | 1711 |
| 1104126 | N/A | N/A | 9506 | 9525 | TTAGCCTTTCTGATGCTGAA | 58 | 1712 |
| 1104142 | N/A | N/A | 9530 | 9549 | TATTACCTCTACTAGTCAGC | 65 | 1713 |
| 1104158 | N/A | N/A | 9557 | 9576 | GACCTGTGACTATCTAGGAT | 18 | 1714 |
| 1104174 | N/A | N/A | 9576 | 9595 | CATTTATCTGTGCTTTAGTG | 37 | 1715 |
| 1104190 | N/A | N/A | 9660 | 9679 | GCTGTTAAACATGTGGCACA | 74 | 1716 |
| 1104206 | N/A | N/A | 9706 | 9725 | CCTACTTCTCTAGGTGGGAG | 65 | 1717 |
| 1104222 | N/A | N/A | 10556 | 10575 | CGGTATTGAAATCAGGAGAC | 47 | 1718 |
| 1104238 | N/A | N/A | 10610 | 10629 | TTTCAGCCCCTCTGCAAGCC | 68 | 1719 |
| 1104254 | N/A | N/A | 10747 | 10766 | CCTCCCCATCATGAGTATGA | 92 | 1720 |
| 1104270 | N/A | N/A | 10816 | 10835 | AGGAGGCCTCTCATGGACTT | 93 | 172 |
| 1104286 | N/A | N/A | 11078 | 11097 | AATTACATTCAGTTTCCTTG | 88 | 1722 |
| 1104302 | N/A | N/A | 11150 | 11169 | TTAGGATCCCATCTAGTGGC | 60 | 1723 |
| 1104318 | N/A | N/A | 11225 | 11244 | TACTAACTTTAATTCTCTTT | 49 | 1724 |
| 1104334 | N/A | N/A | 11280 | 11299 | AAATGGAAAGCCCTCCCCAT | 98 | 1725 |
| 1104350 | N/A | N/A | 11388 | 11407 | TGGTAAGCTGCTGGAGTAAG | 55 | 1726 |
| 1104366 | N/A | N/A | 11494 | 11513 | TTCCCAGGTCTTACTTTTCT | 76 | 1727 |

TABLE 24

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 6 | 517 |
| 1103151 | 39 | 58 | 3487 | 3506 | GGCTCTGCTCGCTCCTGGGA | 108 | 1728 |
| 1103167 | 269 | 288 | 3717 | 3736 | CATCATCTCTGCCCGCTCAC | 93 | 1729 |
| 1103183 | 553 | 572 | 4938 | 4957 | AGGTTGTTCTCGGCTTCCAG | 55* | 1730 |
| 1103199 | 759 | 778 | 5645 | 5664 | TCTCTTTCAGGGCTGCGGTG | 54 | 1731 |
| 1103215 | 1050 | 1069 | 7622 | 7641 | CCTCTTCCTCCAGCCGCGCC | 64 | 1732 |
| 1103231 | 1334 | 1353 | 11623 | 11642 | CTTGTGCTCCTGCTTGGACT | 53 | 1733 |
| 1103247 | 1518 | 1537 | 11807 | 11826 | ACTGACGGAGCCTAGGGCAG | 61 | 1734 |
| 1103263 | 1667 | 1686 | 11956 | 11975 | AGGTGCCCCCCGCCCTCCTC | 98 | 1735 |
| 1103279 | 1730 | 1749 | 12019 | 12038 | ACCTCCATCTCTGGCAACAG | 25 | 1736 |
| 1103295 | 1859 | 1878 | 12148 | 12167 | CAAAAGACAAAACAAGCCTC | 73 | 1737 |
| 1103311 | 1885 | 1904 | 12174 | 12193 | ATAGGGATATCCCACCTCAT | 75 | 1738 |
| 1103327 | 2086 | 2105 | 12375 | 12394 | TCAGGAGGTCCTTCTGGGAT | 67 | 1739 |
| 1103343 | 2230 | 2249 | 12519 | 12538 | TATCCCTCCCAGCACCTCAT | 63 | 1740 |
| 1103359 | 2425 | 2444 | 12714 | 12733 | GATGAGTCACTTCCTTAATT | 35 | 1741 |
| 1103375 | 2483 | 2502 | 12772 | 12791 | TCATGCCCTGCCCCCATGGA | 69 | 1742 |
| 1103391 | 2511 | 2530 | 12800 | 12819 | GGAAGAGGCCTTTAGAAATG | 74 | 1743 |
| 1103407 | 2670 | 2689 | 12959 | 12978 | GTGTGAGTAAGAAGGGACCG | 46 | 1744 |
| 1103423 | 2722 | 2741 | 13011 | 13030 | AGTTTTACAATTGTAAAATA | 88 | 1745 |
| 1103439 | 2868 | 2887 | 13157 | 13176 | ATCTCTGGGCACAGATCCCA | 93 | 1746 |
| 1103471 | N/A | N/A | 8770 | 8789 | AGATATCTTGTGACCTTGTG | 35 | 1747 |
| 1103487 | N/A | N/A | 8898 | 8917 | AGGCTCACTCCCTGTCAAGC | 62 | 1748 |
| 1103503 | N/A | N/A | 9044 | 9063 | ACAAGCTCTGCCAGTTTAAT | 51 | 1749 |
| 1103519 | N/A | N/A | 9225 | 9244 | ACTGAGCTGAGCGATGGAGC | 65 | 1750 |
| 1103535 | N/A | N/A | 9266 | 9285 | AGCTGCGGTCCTGAGGGAAG | 59 | 1751 |
| 1103551 | N/A | N/A | 9309 | 9328 | TTAACATTAAGAGCAGGGAA | 68 | 1752 |
| 1103567 | N/A | N/A | 8530 | 8549 | GGTATGATAGGCTCTGGCTA | 21 | 1753 |
| 1103583 | N/A | N/A | 8649 | 8668 | AGACAGGGCAGATGTCAAGC | 90 | 1754 |
| 1103599 | N/A | N/A | 3994 | 4013 | TCTGCTCACAAGGCCCCCCT | 56 | 1755 |
| 1103615 | N/A | N/A | 4053 | 4072 | GGGAGGTTCGGCCCCTCCCT | 94 | 1756 |
| 1103631 | N/A | N/A | 4251 | 4270 | AGCCATGAATGAAACACAGG | 115 | 1757 |
| 1103647 | N/A | N/A | 4401 | 4420 | TGCGCCCAGACCTGCCTGCT | 75 | 1758 |
| 1103663 | N/A | N/A | 4495 | 4514 | AAATGAATTTTATTATGACC | 80 | 1759 |
| 1103679 | N/A | N/A | 4636 | 4655 | CAAGCATACACTCACTGTTG | 69 | 1760 |
| 1103695 | N/A | N/A | 4820 | 4839 | AGGCAGCTGTCACAGAGACC | 95 | 1761 |
| 1103711 | N/A | N/A | 5099 | 5118 | CATTCCTCAGCCTTGCCTTA | 95 | 1762 |
| 1103727 | N/A | N/A | 5311 | 5330 | TCCCTCTCTCAGTTGCAATC | 79 | 1763 |

TABLE 24-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103743 | N/A | N/A | 5412 | 5431 | TCTTTCTGTTTGTCTTTCAT | 71 | 1764 |
| 1103759 | N/A | N/A | 5482 | 5501 | GTGTCCTCTTCTGCCTGCCC | 59 | 1765 |
| 1103775 | N/A | N/A | 5775 | 5794 | TCTCTTGTACAGAGCAAGAA | 110 | 1766 |
| 1103791 | N/A | N/A | 5853 | 5872 | AGCCATCTCACTTCTCTGGT | 67 | 1767 |
| 1103807 | N/A | N/A | 5930 | 5949 | ACTACTAATAATAGCAATAG | 82 | 1768 |
| 1103823 | N/A | N/A | 5975 | 5994 | GTAATCCATGAAAAGCACAG | 97 | 1769 |
| 1103839 | N/A | N/A | 6022 | 6041 | CTTCGGCTCTCTCATCTGTC | 76 | 1770 |
| 1103855 | N/A | N/A | 6203 | 6222 | CAGGTCAGACACCTCTCTGT | 76 | 1771 |
| 1103871 | N/A | N/A | 6265 | 6284 | GCTCTGAGCTGTGGTGTTCT | 88 | 1772 |
| 1103887 | N/A | N/A | 6314 | 6333 | CCAAATGCCCCCTCTACAGT | 92 | 1773 |
| 1103903 | N/A | N/A | 6409 | 6428 | CCTCTCTGTGCTTTTCTGCC | 60 | 1774 |
| 1103919 | N/A | N/A | 6516 | 6535 | GGTCCTCCCAGCCCCATCGG | 79 | 1775 |
| 1103935 | N/A | N/A | 6906 | 6925 | CTTAGGCGAGCGGAGGCCTG | 85 | 1776 |
| 1103951 | N/A | N/A | 7021 | 7040 | GCCAGACCTCAGCACCTAGC | 65 | 1777 |
| 1103967 | N/A | N/A | 7316 | 7335 | GCTCACCGTGCCGCGCAGAG | 76 | 1778 |
| 1103983 | N/A | N/A | 7420 | 7439 | TCAGGCCCCGCCCTCGACCC | 88 | 1779 |
| 1103999 | N/A | N/A | 7806 | 7825 | AGATGAGCTCTACCGTGAGG | 66 | 1780 |
| 1104015 | N/A | N/A | 7930 | 7949 | ATCCATTCAGTCATCAAACA | 90 | 1781 |
| 1104031 | N/A | N/A | 8037 | 8056 | GTGAGGAGTCCAATCTTGGC | 77 | 1782 |
| 1104047 | N/A | N/A | 8076 | 8095 | GGTGAAGAAAGTTCCAAGGA | 59 | 1783 |
| 1104063 | N/A | N/A | 8229 | 8248 | TTTTCCTTGCCAGGAAAGTC | 76 | 1784 |
| 1104079 | N/A | N/A | 9360 | 9379 | CCCCCGCCCCGCCCGAGAGA | 103 | 1785 |
| 1104095 | N/A | N/A | 9413 | 9432 | CTAAGAATCATTTCAGGGCC | 65 | 1786 |
| 1104111 | N/A | N/A | 9454 | 9473 | TAAATATTCTAGTCCAGAAG | 87 | 1787 |
| 1104127 | N/A | N/A | 9508 | 9527 | GGTTAGCCTTTCTGATGCTG | 30 | 1788 |
| 1104143 | N/A | N/A | 9531 | 9550 | GTATTACCTCTACTAGTCAG | 56 | 1789 |
| 1104159 | N/A | N/A | 9558 | 9577 | TGACCTGTGACTATCTAGGA | 29 | 1790 |
| 1104175 | N/A | N/A | 9578 | 9597 | GCCATTTATCTGTGCTTTAG | 10 | 1791 |
| 104191 | N/A | N/A | 9664 | 9683 | AAAGGCTGTTAAACATGTGG | 39 | 1792 |
| 1104207 | N/A | N/A | 9707 | 9726 | GCCTACTTCTCTAGGTGGGA | 69 | 1793 |
| 1104223 | N/A | N/A | 10557 | 10576 | ACGGTATTGAAATCAGGAGA | 55 | 1794 |
| 1104239 | N/A | N/A | 10639 | 10658 | TGGCTGCTCTGTCTTCTGGC | 52 | 1795 |
| 1104255 | N/A | N/A | 10748 | 10767 | CCCTCCCCATCATGAGTATG | 79 | 1796 |
| 1104271 | N/A | N/A | 10817 | 10836 | GAGGAGGCCTCTCATGGACT | 95 | 1797 |
| 1104287 | N/A | N/A | 11082 | 11101 | ACGGAATTACATTCAGTTTC | 77 | 1798 |
| 1104303 | N/A | N/A | 11151 | 11170 | ATTAGGATCCCATCTAGTGG | 68 | 1799 |

TABLE 24-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104319 | N/A | N/A | 11229 | 11248 | AAGCTACTAACTTTAATTCT | 92 | 1800 |
| 1104335 | N/A | N/A | 11281 | 11300 | GAAATGGAAAGCCCTCCCCA | 113 | 1801 |
| 1104351 | N/A | N/A | 11389 | 11408 | GTGGTAAGCTGCTGGAGTAA | 60 | 1802 |
| 1104367 | N/A | N/A | 11498 | 11517 | CGACTTCCCAGGTCTTACTT | 74 | 1803 |

TABLE 25

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 7 | 517 |
| 1103153 | 44 | 63 | 3492 | 3511 | GCTCTGGCTCTGCTCGCTCC | 83 | 1804 |
| 1103169 | 354 | 373 | 3802 | 3821 | GGTTCAGCTCAGCAGCCAGC | 85 | 1805 |
| 1103185 | 566 | 585 | 4951 | 4970 | TCTATAGGCAGCCAGGTTGT | 73* | 1806 |
| 1103201 | 762 | 781 | 5648 | 5667 | GGATCTCTTTCAGGGCTGCG | 90 | 1807 |
| 1103217 | 1185 | 1204 | N/A | N/A | GAATGGTGATCCGGTTCTCC | 23 | 1808 |
| 1103233 | 1350 | 1369 | 11639 | 11658 | TGCCTCACATCACATCCTTG | 98 | 1809 |
| 1103249 | 1528 | 1547 | 11817 | 11836 | CAGGCCTGATACTGACGGAG | 103 | 1810 |
| 1103265 | 1670 | 1689 | 11959 | 11978 | AGTAGGTGCCCCCCGCCCTC | 74 | 1811 |
| 1103281 | 1750 | 1769 | 12039 | 12058 | TTCCCAGATACTCCGAGAGA | 65 | 1812 |
| 1103297 | 1861 | 1880 | 12150 | 12169 | ACCAAAAGACAAAACAAGCC | 113 | 1813 |
| 1103313 | 1887 | 1906 | 12176 | 12195 | GCATAGGGATATCCCACCTC | 95 | 1814 |
| 1103329 | 2097 | 2116 | 12386 | 12405 | TGAGTCATCGCTCAGGAGGT | 47 | 1815 |
| 1103345 | 2331 | 2350 | 12620 | 12639 | TCCTCCTCCATCTCTACCAG | 44 | 1816 |
| 1103361 | 2431 | 2450 | 12720 | 12739 | CAAGAGGATGAGTCACTTCC | 49 | 1817 |
| 1103377 | 2485 | 2504 | 12774 | 12793 | AGTCATGCCCTGCCCCCATG | 46 | 1818 |
| 1103393 | 2516 | 2535 | 12805 | 12824 | AGCAAGGAAGAGGCCTTTAG | 68 | 1819 |
| 1103409 | 2673 | 2692 | 12962 | 12981 | TGTGTGTGAGTAAGAAGGGA | 30 | 1820 |
| 1103425 | 2725 | 2744 | 13014 | 13033 | CTCAGTTTTACAATTGTAAA | 71 | 1821 |
| 1103441 | 2905 | 2924 | 13194 | 13213 | GGGAGAGGAGAACCCTGAAG | 98 | 1822 |
| 1103473 | N/A | N/A | 8813 | 8832 | CTGGTGAGCCTGTATTGGTA | 68 | 1823 |
| 1103489 | N/A | N/A | 8975 | 8994 | AAAATGACGCAGTCCAGGCC | 108 | 1824 |
| 1103505 | N/A | N/A | 9046 | 9065 | TAACAAGCTCTGCCAGTTTA | 92 | 1825 |
| 1103521 | N/A | N/A | 9238 | 9257 | GAACTGAGTCAGCACTGAGC | 124 | 1826 |
| 1103537 | N/A | N/A | 9279 | 9298 | TATTCACTGCAAGAGCTGCG | 111 | 1827 |
| 1103553 | N/A | N/A | 9313 | 9332 | ATATTTAACATTAAGAGCAG | 84 | 1828 |
| 1103569 | N/A | N/A | 8533 | 8552 | CCTGGTATGATAGGCTCTGG | 56 | 1829 |

TABLE 25-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103585 | N/A | N/A | 8655 | 8674 | ATCTGCAGACAGGGCAGATG | 113 | 1830 |
| 1103601 | N/A | N/A | 4001 | 4020 | AGCCCCTTCTGCTCACAAGG | 74 | 1831 |
| 1103617 | N/A | N/A | 4172 | 4191 | CCTGGCAGAAGGCATGCGGG | 120 | 1832 |
| 1103633 | N/A | N/A | 4295 | 4314 | CAGGCTCAGAATAGGTGAGC | 80 | 1833 |
| 1103649 | N/A | N/A | 4410 | 4429 | CCTGTGCTTTGCGCCCAGAC | 92 | 1834 |
| 1103665 | N/A | N/A | 4505 | $524 | CCACCTTTTGAAATGAATTT | 63 | 1835 |
| 1103681 | N/A | N/A | 4641 | 4660 | ATCCACAAGCATACACTCAC | 62 | 1836 |
| 1103697 | N/A | N/A | 4845 | 4864 | TGAATACCTGCCTCAGTCTC | 68 | 1837 |
| 1103713 | N/A | N/A | 5101 | 5120 | CCCATTCCTCAGCCTTGCCT | 95 | 1838 |
| 1103729 | N/A | N/A | 5351 | 5370 | TGAGTGTCTCTCTCAGTCTC | 132 | 1839 |
| 1103745 | N/A | N/A | 5420 | 5439 | CCTTAGTGTCTTTCTGTTTG | 69 | 1840 |
| 1103761 | N/A | N/A | 5489 | 5508 | CGCCATTGTGTCCTCTTCTG | 86 | 1841 |
| 1103777 | N/A | N/A | 5778 | 5797 | CATTCTCTTGTACAGAGCAA | 105 | 1842 |
| 1103793 | N/A | N/A | 5861 | 5880 | CCTGGGCAAGCCATCTCACT | 119 | 1843 |
| 1103809 | N/A | N/A | 5943 | 5962 | AACAGTATCAGCTACTACTA | 80 | 1844 |
| 1103825 | N/A | N/A | 5979 | 5998 | TAAGGTAATCCATGAAAAGC | 101 | 1845 |
| 1103841 | N/A | N/A | 6108 | 6127 | CCCAAGTGAGATGTGCTAGA | 118 | 1846 |
| 1103857 | N/A | N/A | 6205 | 6224 | TCCAGGTCAGACACCTCTCT | 97 | 1847 |
| 1103873 | N/A | N/A | 6268 | 6287 | TAAGCTCTGAGCTGTGGTGT | 51 | 1848 |
| 1103889 | N/A | N/A | 6316 | 6335 | GCCCAAATGCCCCCTCTACA | 73 | 1849 |
| 1103905 | N/A | N/A | 6415 | 6434 | GCCCTGCCTCTCTGTGCTTT | 64 | 1850 |
| 1103921 | N/A | N/A | 6522 | 6541 | CAGGGAGGTCCTCCCAGCCC | 101 | 1851 |
| 1103937 | N/A | N/A | 6948 | 6967 | TTCCACACTGACAGCTGCAT | 76 | 1852 |
| 1103953 | N/A | N/A | 7077 | 7096 | TGGCTGGGACTTTTCCCAAC | 113 | 1853 |
| 1103969 | N/A | N/A | 7330 | 7349 | CCTGCCCTGGCCGCGCTCAC | 87 | 1854 |
| 1103985 | N/A | N/A | 7423 | 7442 | CGTTCAGGCCCCGCCCTCGA | 78 | 1855 |
| 1104001 | N/A | N/A | 7815 | 7834 | AAGGGAGCAAGATGAGCTCT | 77 | 1856 |
| 1104017 | N/A | N/A | 7956 | 7975 | CTAATCAATATTGGTTGAAT | 87 | 1857 |
| 1104033 | N/A | N/A | 8039 | 8058 | AGGTGAGGAGTCCAATCTTG | 82 | 1858 |
| 1104049 | N/A | N/A | 8082 | 8101 | GAAAGTGGTGAAGAAAGTTC | 109 | 1859 |
| 1104065 | N/A | N/A | 8252 | 8271 | CCATCATGACAACTTGAACG | 110 | 1860 |
| 1104081 | N/A | N/A | 9377 | 9396 | AATTTAGCTCCCCCCTCCCC | 83 | 1861 |
| 1104097 | N/A | N/A | 9417 | 9436 | TTAGCTAAGAATCATTTCAG | 125 | 1862 |
| 1104113 | N/A | N/A | 9456 | 9475 | CCTAAATATTCTAGTCCAGA | 47 | 1863 |
| 1104129 | N/A | N/A | 9511 | 9530 | CCTGGTTAGCCTTTCTGATG | 47 | 1864 |
| 1104145 | N/A | N/A | 9537 | 9556 | TTGGCAGTATTACCTCTACT | 19 | 1865 |

TABLE 25-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104161 | N/A | N/A | 9561 | 9580 | TAGTGACCTGTGACTATCTA | 47 | 1866 |
| 1104177 | N/A | N/A | 9580 | 9599 | CTGCCATTTATCTGTGCTTT | 52 | 1867 |
| 1104193 | N/A | N/A | 9672 | 9691 | ACTAAAATAAAGGCTGTTAA | 67 | 1868 |
| 1104209 | N/A | N/A | 9786 | 9805 | AACCAGCCACATGACTCTGG | 91 | 1869 |
| 1104225 | N/A | N/A | 10559 | 10578 | GCACGGTATTGAAATCAGGA | 30 | 1870 |
| 1104241 | N/A | N/A | 10655 | 10674 | GCTGCTGCCAGAGTCCTGGC | 69 | 1871 |
| 1104257 | N/A | N/A | 10761 | 10780 | CCCCATCGCACCCCCCTCCC | 103 | 1872 |
| 1104273 | N/A | N/A | 10843 | 10862 | CAGGCTGGTTTCTGCAGATG | 92 | 1873 |
| 1104289 | N/A | N/A | 11084 | 11103 | AAACGGAATTACATTCAGTT | 67 | 1874 |
| 1104305 | N/A | N/A | 11153 | 11172 | GTATTAGGATCCCATCTAGT | 58 | 1875 |
| 1104321 | N/A | N/A | 11231 | 11250 | GAAAGCTACTAACTTTAATT | 60 | 1876 |
| 1104337 | N/A | N/A | 11308 | 11327 | CCCTGGTAGTTTCCTTTTAC | 55 | 1877 |
| 1104353 | N/A | N/A | 11392 | 11411 | CGAGTGGTAAGCTGCTGGAG | 69 | 1878 |
| 1104369 | N/A | N/A | 11512 | 11531 | CCTTGGGAAGTCCCCGACTT | 78 | 1879 |

TABLE 26

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 6 | 517 |
| 1103154 | 109 | 128 | 3557 | 3576 | ATCATCTCCCCTGAGGAGAC | 139 | 1880 |
| 1103170 | 376 | 395 | 3824 | 3843 | GTGGGCTCCTTGGCCCGCAG | 89 | 1881 |
| 1103186 | 576 | 595 | N/A | N/A | CTGCTTCCTGTCTATAGGCA | 30* | 1882 |
| 1103202 | 763 | 782 | 5649 | 5668 | CGGATCTCTTTCAGGGCTGC | 38 | 1883 |
| 1103218 | 1202 | 1221 | 8351 | 8370 | GGAGAAGGTCTGCACGGGAA | 43 | 1884 |
| 1103234 | 1355 | 1374 | 11644 | 11663 | GGTCCTGCCTCACATCACAT | 87 | 1885 |
| 1103250 | 1532 | 1551 | 11821 | 11840 | CTGGCAGGCCTGATACTGAC | 93 | 1886 |
| 1103266 | 1679 | 1698 | 11968 | 11987 | GGGCGATGTAGTAGGTGCCC | 100 | 1887 |
| 1103282 | 1762 | 1781 | 12051 | 12070 | TCAAAGGCACAGTTCCCAGA | 89 | 1888 |
| 1103298 | 1862 | 1881 | 12151 | 12170 | AACCAAAAGACAAAACAAGC | 80 | 1889 |
| 1103314 | 1889 | 1908 | 12178 | 12197 | CAGCATAGGGATATCCCACC | 86 | 1890 |
| 1103330 | 2098 | 2117 | 12387 | 12406 | TTGAGTCATCGCTCAGGAGG | 49 | 1891 |
| 1103346 | 2332 | 2351 | 12621 | 12640 | CTCCTCCTCCATCTCTACCA | 81 | 1892 |
| 1103362 | 2436 | 2455 | 12725 | 12744 | ATCTTCAAGAGGATGAGTCA | 116 | 1893 |
| 1103378 | 2487 | 2506 | 12776 | 12795 | AAAGTCATGCCCTGCCCCCA | 74 | 1894 |
| 1103394 | 2526 | 2545 | 12815 | 12834 | GGTATGACACAGCAAGGAAG | 59 | 1895 |

TABLE 26-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103410 | 2674 | 2693 | 12963 | 12982 | TTGTGTGTGAGTAAGAAGGG | 52 | 1896 |
| 1103426 | 2730 | 2749 | 13019 | 13038 | CGTGCCTCAGTTTTACAATT | 73 | 1897 |
| 1103442 | 2963 | 2982 | 13252 | 13271 | TGGAGGGAAAGGACACCAAG | 79 | 1898 |
| 1103458 | N/A | N/A | 8740 | 8759 | TCTTTGGTGCTTTTGCCCCC | 50 | 1899 |
| 1103474 | N/A | N/A | 8814 | 8833 | TCTGGTGAGCCTGTATTGGT | 66 | 1900 |
| 1103490 | N/A | N/A | 8978 | 8997 | GGGAAAATGACGCAGTCCAG | 80 | 1901 |
| 1103506 | N/A | N/A | 9076 | 9095 | GCGCACCCAAGGACTCACCA | 115 | 1902 |
| 1103522 | N/A | N/A | 9240 | 9259 | CTGAACTGAGTCAGCACTGA | 90 | 1903 |
| 1103538 | N/A | N/A | 9285 | 9304 | AAACTTTATTCACTGCAAGA | 57 | 1904 |
| 1103570 | N/A | N/A | 8537 | 8556 | GTACCCTGGTATGATAGGCT | 22 | 1905 |
| 1103586 | N/A | N/A | 8684 | 8703 | ACACTCAGAAGGGCAGTGCT | 115 | 1906 |
| 1103602 | N/A | N/A | 4002 | 4021 | CAGCCCCTTCTGCTCACAAG | 77 | 1907 |
| 1103618 | N/A | N/A | 4181 | 4200 | CCCTGGACTCCTGGCAGAAG | 98 | 1908 |
| 1103634 | N/A | N/A | 4336 | 4355 | CATCAACCTTCTCCGCTTCC | 75 | 1909 |
| 1103650 | N/A | N/A | 4411 | 4430 | ACCTGTGCTTTGCGCCCAGA | 92 | 1910 |
| 1103666 | N/A | N/A | 4566 | 4585 | TGCATGTCCTGTCAGCTCAG | 122 | 1911 |
| 1103682 | N/A | N/A | 4645 | 4664 | GCGCATCCACAAGCATACAC | 113 | 1912 |
| 1103698 | N/A | N/A | 4846 | 4865 | TTGAATACCTGCCTCAGTCT | 104 | 1913 |
| 1103714 | N/A | N/A | $140 | 5159 | TGAGGAGTAGAGGGCCACTG | 64 | 1914 |
| 1103730 | N/A | N/A | 5353 | 5372 | TCTGAGTGTCTCTCTCAGTC | 135 | 1915 |
| 1103746 | N/A | N/A | 5422 | 5441 | TCCCTTAGTGTCTTTCTGTT | 101 | 1916 |
| 1103762 | N/A | N/A | 5494 | 5513 | CCCCACGCCATTGTGTCCTC | 85 | 1917 |
| 1103778 | N/A | N/A | 5780 | 5799 | CCCATTCTCTTGTACAGAGC | 72 | 1918 |
| 1103794 | N/A | N/A | 5862 | 5881 | CCCTGGGCAAGCCATCTCAC | 80 | 1919 |
| 1103810 | N/A | N/A | 5948 | 5967 | AACAGAACAGTATCAGCTAC | 82 | 1920 |
| 1103826 | N/A | N/A | 5980 | 5999 | GTAAGGTAATCCATGAAAAG | 73 | 1921 |
| 1103842 | N/A | N/A | 6112 | 6131 | GGCTCCCAAGTGAGATGTGC | 118 | 1922 |
| 1103858 | N/A | N/A | 6207 | 6226 | CTTCCAGGTCAGACACCTCT | 75 | 1923 |
| 1103874 | N/A | N/A | 6269 | 6288 | ATAAGCTCTGAGCTGTGGTG | 50 | 1924 |
| 1103890 | N/A | N/A | 6317 | 6336 | AGCCCAAATGCCCCCTCTAC | 77 | 1925 |
| 1103906 | N/A | N/A | 6449 | 6468 | CAGCTAGGTGCCCTGGCTAG | 131 | 1926 |
| 1103922 | N/A | N/A | 6531 | 6550 | CCCTGCCTGCAGGGAGGTCC | 69 | 1927 |
| 1103938 | N/A | N/A | 6970 | 6989 | CAGTGCCACAGAATCCAGAA | 94 | 1928 |
| 1103954 | N/A | N/A | 7104 | 7123 | CCCCAGTTAACCCCAGGACG | 130 | 1929 |
| 1103970 | N/A | N/A | 7337 | 7356 | TCCCCGTCCTGCCCTGGCCG | 65 | 1930 |
| 1103986 | N/A | N/A | 7454 | 7473 | GCCCCAGGCCCCGCCTCTAG | 174 | 1931 |

TABLE 26-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104002 | N/A | N/A | 7824 | 7843 | CAGTCCCTGAAGGGAGCAAG | 113 | 1932 |
| 1104018 | N/A | N/A | 7958 | 7977 | GCCTAATCAATATTGGTTGA | 71 | 1933 |
| 1104034 | N/A | N/A | 8041 | 8060 | TGAGGTGAGGAGTCCAATCT | 69 | 1934 |
| 1104050 | N/A | N/A | 8107 | 8126 | CTGAAGGAAGATGGAAAAGG | 78 | 1935 |
| 1104066 | N/A | N/A | 8254 | 8273 | GGCCATCATGACAACTTGAA | 105 | 1936 |
| 1104082 | N/A | N/A | 9378 | 9397 | TAATTTAGCTCCCCCCTCCC | 106 | 1937 |
| 1104098 | N/A | N/A | 9418 | 9437 | CTTAGCTAAGAATCATTTCA | 96 | 1938 |
| 1104114 | N/A | N/A | 9457 | 9476 | TCCTAAATATTCTAGTCCAG | 63 | 1939 |
| 1104130 | N/A | N/A | 9513 | 9532 | AGCCTGGTTAGCCTTTCTGA | 68 | 1940 |
| 1104146 | N/A | N/A | 9538 | 9557 | TTTGGCAGTATTACCTCTAC | 73 | 1941 |
| 1104162 | N/A | N/A | 9562 | 9581 | TTAGTGACCTGTGACTATCT | 92 | 1942 |
| 1104178 | N/A | N/A | 9582 | 9601 | CTCTGCCATTTATCTGTGCT | 48 | 1943 |
| 1104194 | N/A | N/A | 9675 | 9694 | TTAACTAAAATAAAGGCTGT | 132 | 1944 |
| 1104210 | N/A | N/A | 9810 | 9829 | TCAAGAAGTCCCAACTTAGC | 74 | 1945 |
| 1104226 | N/A | N/A | 10560 | 10579 | AGCACGGTATTGAAATCAGG | 77 | 1946 |
| 1104242 | N/A | N/A | 10656 | 10675 | TGCTGCTGCCAGAGTCCTGG | 89 | 1947 |
| 1104258 | N/A | N/A | 10773 | 10792 | CATGCCCGGCTTCCCCATCG | 98 | 1948 |
| 1104274 | N/A | N/A | 10923 | 10942 | CTTACCTCTCCATCCCGCAT | 100 | 1949 |
| 1104290 | N/A | N/A | 11088 | 11107 | GAGGAAACGGAATTACATTC | 95 | 1950 |
| 1104306 | N/A | N/A | 11154 | 11173 | TGTATTAGGATCCCATCTAG | 135 | 1951 |
| 1104322 | N/A | N/A | 11232 | 11251 | TGAAAGCTACTAACTTTAAT | 75 | 1952 |
| 1104338 | N/A | N/A | 11312 | 11331 | ATTCCCCTGGTAGTTTCCTT | 97 | 1953 |
| 1104354 | N/A | N/A | 11393 | 11412 | GCGAGTGGTAAGCTGCTGGA | 57 | 1954 |
| 1104370 | N/A | N/A | 11523 | 11542 | AGGCTGTGTAACCTTGGGAA | 75 | 1955 |

TABLE 27

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 306 | 13336 | 13355 | GTCTTTATTTTTCCTCAGCG | 7 | 517 |
| 1103155 | 110 | 129 | 3558 | 3577 | CATCATCTCCCCTGAGGAGA | 90 | 1956 |
| 1103171 | 380 | 399 | 3828 | 3847 | CTTGGTGGGCTCCTTGGCCC | 103 | 1957 |
| 1103187 | 577 | 596 | N/A | N/A | TCTGCTTCCTGTCTATAGGC | 33* | 1958 |
| 1103203 | 764 | 783 | 5650 | 5669 | GCGGATCTCTTTCAGGGCTG | 65 | 1959 |
| 1103219 | 1220 | 1239 | N/A | N/A | TTCTCGAATCTGCAGGTTGG | 111 | 1960 |
| 1103235 | 1361 | 1380 | 11650 | 11669 | CAGGTGGGTCCTGCCTCACA | 147 | 1961 |

TABLE 27-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103251 | 1533 | 1552 | 11822 | 11841 | TCTGGCAGGCCTGATACTGA | 134 | 1962 |
| 1103267 | 1681 | 1700 | 11970 | 11989 | GAGGGCGATGTAGTAGGTGC | 66 | 1963 |
| 1103283 | 1768 | 1787 | 12057 | 12076 | GGAAACTCAAAGGCACAGTT | 72 | 1964 |
| 1103299 | 1870 | 1889 | 12159 | 12178 | CTCATAAAAACCAAAAGACA | 128 | 1965 |
| 1103315 | 1890 | 1909 | 12179 | 12198 | GCAGCATAGGGATATCCCAC | 89 | 1966 |
| 1103331 | 2107 | 2126 | 12396 | 12415 | CTGAGACACTTGAGTCATCG | 45 | 1967 |
| 1103347 | 2334 | 2353 | 12623 | 12642 | GCCTCCTCCTCCATCTCTAC | 53 | 1968 |
| 1103363 | 2440 | 2459 | 12729 | 12748 | CAGCATCTTCAAGAGGATGA | 109 | 1969 |
| 1103379 | 2488 | 2507 | 12777 | 12796 | CAAAGTCATGCCCTGCCCCC | 94 | 1970 |
| 1103395 | 2527 | 2546 | 12816 | 12835 | TGGTATGACACAGCAAGGAA | 48 | 1971 |
| 1103411 | 2676 | 2695 | 12965 | 12984 | TTTTGTGTGTGAGTAAGAAG | 43 | 1972 |
| 1103427 | 2750 | 2769 | 13039 | 13058 | GCCAGTGTCTTCACTTTGCT | 73 | 1973 |
| 1103443 | 3013 | 3032 | 13302 | 13321 | CAGTGCCCTGAAGATTAGCA | 68 | 1974 |
| 1103459 | N/A | N/A | 8741 | 8760 | GTCTTTGGTGCTTTTGCCCC | 51 | 1975 |
| 1103475 | N/A | N/A | 8815 | 8834 | ATCTGGTGAGCCTGTATTGG | 45 | 1976 |
| 1103491 | N/A | N/A | 8979 | 8998 | TGGGAAAATGACGCAGTCCA | 61 | 1977 |
| 1103507 | N/A | N/A | 9091 | 9110 | CAGAGCAGCTCCACTGCGCA | 127 | 1978 |
| 1103523 | N/A | N/A | 9241 | 9260 | TCTGAACTGAGTCAGCACTG | 84 | 1979 |
| 1103539 | N/A | N/A | 9286 | 9305 | AAAACTTTATTCACTGCAAG | 64 | 1980 |
| 1103555 | N/A | N/A | 8369 | 8388 | ACCTCGAATCTGCAGGTTGG | 130 | 1981 |
| 1103571 | N/A | N/A | 8538 | 8557 | AGTACCCTGGTATGATAGGC | 33 | 1982 |
| 1103587 | N/A | N/A | 8714 | 8733 | GACAAGCAGTTAAAAAAACA | 62 | 1983 |
| 1103603 | N/A | N/A | 4003 | 4022 | TCAGCCCCTTCTGCTCACAA | 58 | 1984 |
| 1103619 | N/A | N/A | 4210 | 4229 | CTTTCCCCAGTAGGGAGGTG | 86 | 1985 |
| 1103635 | N/A | N/A | 4343 | 4362 | TCATGGACATCAACCTTCTC | 87 | 1986 |
| 1103651 | N/A | N/A | 4414 | 4433 | GTCACCTGTGCTTTGCGCCC | 107 | 1987 |
| 1103667 | N/A | N/A | 4568 | 4587 | CATGCATGTCCTGTCAGCTC | 72 | 1988 |
| 1103683 | N/A | N/A | 4646 | 4665 | GGCGCATCCACAAGCATACA | 112 | 1989 |
| 1103699 | N/A | N/A | 4855 | 4874 | TGAGGACACTTGAATACCTG | 67 | 1990 |
| 1103715 | N/A | N/A | 5163 | 5182 | GCTTCCTGGAGTGGCAGGAG | 109* | 1991 |
| 1103731 | N/A | N/A | 5362 | 538 | TCTCCTCTCTCTGAGTGTCT | 69 | 1992 |
| 1103747 | N/A | N/A | 5424 | 5443 | TCTCCCTTAGTGTCTTTCTG | 65 | 1993 |
| 1103763 | N/A | N/A | 5499 | 5518 | GGGTTCCCCACGCCATTGTG | 109 | 1994 |
| 1103779 | N/A | N/A | 5782 | 5801 | CCCCCATTCTCTTGTACAGA | 136 | 1995 |
| 1103795 | N/A | N/A | 5881 | 5900 | AGCAATAGTGCCTGTGTGAC | 69 | 1996 |
| 1103811 | N/A | N/A | 5949 | 5968 | GAACAGAACAGTATCAGCTA | 91 | 1997 |

TABLE 27-continued

| Reduction of GFAP RNA by 5-10-5 MCE gapmers with mixed PO/PS internucleoside linkages in U251 cells | | | | | | | |
|---|---|---|---|---|---|---|---|
| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
| 1103827 | N/A | N/A | 5981 | 6000 | AGTAAGGTAATCCATGAAAA | 109 | 1998 |
| 1103843 | N/A | N/A | 6113 | 6132 | AGGCTCCCAAGTGAGATGTG | 89 | 1999 |
| 1103859 | N/A | N/A | 6214 | 6233 | ATCACACCTTCCAGGTCAGA | 68 | 2000 |
| 1103875 | N/A | N/A | 6271 | 6290 | ATATAAGCTCTGAGCTGTGG | 87 | 2001 |
| 1103891 | N/A | N/A | 6318 | 6337 | TAGCCCAAATGCCCCCTCTA | 101 | 2002 |
| 1103907 | N/A | N/A | 6454 | 6473 | CTCCTCAGCTAGGTGCCCTG | 66 | 2003 |
| 1103923 | N/A | N/A | 6534 | 6553 | CTCCCCTGCCTGCAGGGAGG | 124 | 2004 |
| 1103939 | N/A | N/A | 6975 | 6994 | ATGAACAGTGCCACAGAATC | 124 | 2005 |
| 1103955 | N/A | N/A | 7105 | 7124 | ACCCCAGTTAACCCCAGGAC | 90 | 2006 |
| 1103971 | N/A | N/A | 7339 | 7358 | CGTCCCCGTCCTGCCCTGGC | 93 | 2007 |
| 1103987 | N/A | N/A | 7473 | 7492 | TTTCGAGGCCCGGCCCCCGG | 78 | 2008 |
| 1104003 | N/A | N/A | 7829 | 7848 | AGACTCAGTCCCTGAAGGGA | 89 | 2009 |
| 1104019 | N/A | N/A | 7959 | 7978 | GGCCTAATCAATATTGGTTG | 80 | 2010 |
| 1104035 | N/A | N/A | 8043 | 8062 | GGTGAGGTGAGGAGTCCAAT | 62 | 2011 |
| 1104051 | N/A | N/A | 8116 | 8135 | CATGTCTATCTGAAGGAAGA | 159 | 2012 |
| 1104067 | N/A | N/A | 8283 | 8302 | GGACACCCCTAGGCTGGGTC | 121 | 2013 |
| 1104083 | N/A | N/A | 9384 | 9403 | AAAAAGTAATTTAGCTCCCC | 108 | 2014 |
| 1104099 | N/A | N/A | 9419 | 9438 | CCTTAGCTAAGAATCATTTC | 76 | 2015 |
| 1104115 | N/A | N/A | 9458 | 9477 | GTCCTAAATATTCTAGTCCA | 55 | 2016 |
| 1104131 | N/A | N/A | 9514 | 9533 | CAGCCTGGTTAGCCTTTCTG | 38 | 2017 |
| 1104147 | N/A | N/A | 9539 | 9558 | ATTTGGCAGTATTACCTCTA | 51 | 2018 |
| 1104163 | N/A | N/A | 9563 | 9582 | TTTAGTGACCTGTGACTATC | 108 | 2019 |
| 1104179 | N/A | N/A | 9583 | 9602 | TCTCTGCCATTTATCTGTGC | 48 | 2020 |
| 1104195 | N/A | N/A | 9676 | 9695 | ATTAACTAAAATAAAGGCTG | 90 | 202 |
| 1104211 | N/A | N/A | 9811 | 9830 | CTCAAGAAGTCCCAACTTAG | 83 | 2022 |
| 1104227 | N/A | N/A | 10562 | 10581 | CCAGCACGGTATTGAAATCA | 50 | 2023 |
| 1104243 | N/A | N/A | 10659 | 10678 | TAGTGCTGCTGCCAGAGTCC | 54 | 2024 |
| 1104259 | N/A | N/A | 10777 | 10796 | CTCCCATGCCCGGCTTCCCC | 147 | 2025 |
| 1104275 | N/A | N/A | 10981 | 11000 | TGGCCTGGCCTTGAGAATCC | 108 | 2026 |
| 1104291 | N/A | N/A | 11100 | 11119 | TATGGAGGGACTGAGGAAAC | 107 | 2027 |
| 1104307 | N/A | N/A | 11155 | 11174 | GTGTATTAGGATCCCATCTA | 19 | 2028 |
| 1104323 | N/A | N/A | 11233 | 11252 | GTGAAAGCTACTAACTTTAA | 51 | 2029 |
| 1104339 | N/A | N/A | 11325 | 11344 | ATCCCCTCTTCCCATTCCCC | 128 | 2030 |
| 1104355 | N/A | N/A | 11394 | 11413 | GGCGAGTGGTAAGCTGCTGG | 99 | 2031 |
| 1104371 | N/A | N/A | 11525 | 11544 | CGAGGCTGTGTAACCTTGGG | 99 | 2032 |

TABLE 28

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 14 | 517 |
| 1103156 | 142 | 161 | 3590 | 3609 | CCCAGACGGCGGCCAGGAGC | 113 | 2033 |
| 1103172 | 408 | 427 | 3856 | 3875 | GCAGCTCAGCCTGGTAGACG | 92 | 2034 |
| 1103188 | 582 | 601 | N/A | N/A | CTTCATCTGCTTCCTGTCTA | 23* | 2035 |
| 1103204 | 829 | 848 | N/A | N/A | AACTTGGAGCGGTACCACTC | 106 | 2036 |
| 1103220 | 1249 | 1268 | 10863 | 10882 | TCTGACACAGACTTGGTGTC | 110 | 2037 |
| 1103236 | 1397 | 1416 | 11686 | 11705 | CTGCTCGGGCCCCTCATGAG | 18 | 2038 |
| 1103252 | 1534 | 1553 | 11823 | 11842 | GTCTGGCAGGCCTGATACTG | 84 | 2039 |
| 1103268 | 1682 | 1701 | 11971 | 11990 | GGAGGGCGATGTAGTAGGTG | 31 | 2040 |
| 1103284 | 1798 | 1817 | 12087 | 12106 | CTGAGTCTCAGTTTTCCTCC | 48 | 2041 |
| 1103300 | 1871 | 1890 | 12160 | 12179 | CCTCATAAAAACCAAAAGAC | 76 | 2042 |
| 1103316 | 1891 | 1910 | 12180 | 12199 | GGCAGCATAGGGATATCCCA | 74 | 2043 |
| 1103332 | 2108 | 2127 | 12397 | 12416 | ACTGAGACACTTGAGTCATC | 77 | 2044 |
| 1103348 | 2339 | 2358 | 12628 | 12647 | CAATTGCCTCCTCCTCCATC | 9] | 2045 |
| 1103364 | 2444 | 2463 | 12733 | 12752 | GTTTCAGCATCTTCAAGAGG | 63 | 2046 |
| 1103380 | 2489 | 2508 | 12778 | 12797 | ACAAAGTCATGCCCTGCCCC | 89 | 2047 |
| 1103396 | 2528 | 2547 | 12817 | 12836 | CTGGTATGACACAGCAAGGA | 67 | 2048 |
| 1103412 | 2677 | 2696 | 12966 | 12985 | ATTTTGTGTGTGAGTAAGAA | 49 | 2049 |
| 1103428 | 2752 | 2771 | 13041 | 13060 | GAGCCAGTGTCTTCACTTTG | 38 | 2050 |
| 1103444 | 3014 | 3033 | 13303 | 13322 | GCAGTGCCCTGAAGATTAGC | 88 | 2051 |
| 1103460 | N/A | N/A | 8746 | 8765 | TCCCCGTCTTTGGTGCTTTT | 74 | 2052 |
| 1103476 | N/A | N/A | 8823 | 8842 | CATTTACAATCTGGTGAGCC | 103 | 2053 |
| 1103492 | N/A | N/A | 8981 | 9000 | CCTGGGAAAATGACGCAGTC | 88 | 2054 |
| 1103508 | N/A | N/A | 9103 | 9122 | GCTCAGAGGCCCCAGAGCAG | 117 | 2055 |
| 1103524 | N/A | N/A | 9242 | 9261 | CTCTGAACTGAGTCAGCACT | 93 | 2056 |
| 1103540 | N/A | N/A | 9288 | 9307 | ATAAAACTTTATTCACTGCA | 82 | 2057 |
| 1103556 | N/A | N/A | 8397 | 8416 | GCCCTTCCCACGAGGCCCTG | 102 | 2058 |
| 1103572 | N/A | N/A | 8540 | 8559 | GAAGTACCCTGGTATGATAG | 80 | 2059 |
| 1103588 | N/A | N/A | 8715 | 8734 | TGACAAGCAGTTAAAAAAAC | 98 | 2060 |
| 1103604 | N/A | N/A | 4004 | 4023 | TTCAGCCCCTTCTGCTCACA | 97 | 2061 |
| 1103620 | N/A | N/A | 4212 | 423 | TGCTTTCCCCAGTAGGGAGG | 52 | 2062 |
| 1103636 | N/A | N/A | 4351 | 4370 | AATCTCCCTCATGGACATCA | 102 | 2063 |
| 1103652 | N/A | N/A | 4421 | 4440 | GCAGGCAGTCACCTGTGCTT | 84 | 2064 |
| 1103668 | N/A | N/A | 4576 | 4595 | AAGGCACACATGCATGTCCT | 103 | 2065 |
| 1103684 | N/A | N/A | 4663 | 4682 | CTGCTTCTGCTCACACAGGC | 109 | 2066 |
| 1103700 | N/A | N/A | 4856 | 4875 | CTGAGGACACTTGAATACCT | 120 | 2067 |
| 1103716 | N/A | N/A | 5165 | 5184 | CTGCTTCCTGGAGTGGCAGG | 123* | 2068 |

TABLE 28-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103732 | N/A | N/A | 5363 | 5382 | CTCTCCTCTCTCTGAGTGTC | 100 | 2069 |
| 1103748 | N/A | N/A | 5432 | 5451 | TCTTTCCGTCTCCCTTAGTG | 94 | 2070 |
| 1103764 | N/A | N/A | 5518 | 5537 | AGGGTACAGGCCACAGCTGG | 101 | 2071 |
| 1103780 | N/A | N/A | 5785 | 5804 | CTTCCCCCATTCTCTTGTAC | 106 | 2072 |
| 1103796 | N/A | N/A | 5883 | 5902 | AAAGCAATAGTGCCTGTGTG | 80 | 2073 |
| 1103812 | N/A | N/A | 5950 | 5969 | AGAACAGAACAGTATCAGCT | 96 | 2074 |
| 1103828 | N/A | N/A | 5982 | 6001 | TAGTAAGGTAATCCATGAAA | 110 | 2075 |
| 1103844 | N/A | N/A | 6126 | 6145 | AGGCATGGAATGCAGGCTCC | 103 | 2076 |
| 1103860 | N/A | N/A | 6215 | 6234 | TATCACACCTTCCAGGTCAG | 102 | 2077 |
| 1103876 | N/A | N/A | 6272 | 6291 | CATATAAGCTCTGAGCTGTG | 91 | 2078 |
| 1103892 | N/A | N/A | 6319 | 6338 | CTAGCCCAAATGCCCCCTCT | 103 | 2079 |
| 1103908 | N/A | N/A | 6456 | 6475 | CACTCCTCAGCTAGGTGCCC | 104 | 2080 |
| 1103924 | N/A | N/A | 6535 | 6554 | TCTCCCCTGCCTGCAGGGAG | 111 | 2081 |
| 1103940 | N/A | N/A | 6977 | 6996 | GAATGAACAGTGCCACAGAA | 94 | 2082 |
| 1103956 | N/A | N/A | 7106 | 7125 | CACCCCAGTTAACCCCAGGA | 102 | 2083 |
| 1103972 | N/A | N/A | 7340 | 7359 | CCGTCCCCGTCCTGCCCTGG | 90 | 2084 |
| 1103988 | N/A | N/A | 7474 | 7493 | GTTTCGAGGCCCGGCCCCCG | 117 | 2085 |
| 1104004 | N/A | N/A | 7831 | 7850 | AAAGACTCAGTCCCTGAAGG | 119 | 2086 |
| 1104020 | N/A | N/A | 7960 | 7979 | AGGCCTAATCAATATTGGTT | 112 | 2087 |
| 1104036 | N/A | N/A | 8044 | 8063 | GGGTGAGGTGAGGAGTCCAA | 68 | 2088 |
| 1104052 | N/A | N/A | 8117 | 8136 | GCATGTCTATCTGAAGGAAG | 94 | 2089 |
| 1104068 | N/A | N/A | 8289 | 8308 | TGCCTGGGACACCCCTAGGC | 122 | 2090 |
| 1104084 | N/A | N/A | 9385 | 9404 | TAAAAAGTAATTTAGCTCCC | 91 | 2091 |
| 1104100 | N/A | N/A | 9427 | 9446 | ATTTTGTTCCTTAGCTAAGA | 96 | 2092 |
| 1104116 | N/A | N/A | 9459 | 9478 | GGTCCTAAATATTCTAGTCC | 35 | 2093 |
| 1104132 | N/A | N/A | 9515 | 9534 | TCAGCCTGGTTAGCCTTTCT | 37 | 2094 |
| 1104148 | N/A | N/A | 9540 | 9559 | GATTTGGCAGTATTACCTCT | 52 | 2095 |
| 1104164 | N/A | N/A | 9564 | 9583 | CTTTAGTGACCTGTGACTAT | 84 | 2096 |
| 1104180 | N/A | N/A | 9588 | 9607 | ACTTCTCTCTGCCATTTATC | 110 | 2097 |
| 1104196 | N/A | N/A | 9677 | 9696 | AATTAACTAAAATAAAGGCT | 108 | 2098 |
| 1104212 | N/A | N/A | 9820 | 9839 | AGACCAGAGCTCAAGAAGTC | 119 | 2099 |
| 1104228 | N/A | N/A | 10563 | 10582 | CCCAGCACGGTATTGAAATC | 84 | 2100 |
| 1104244 | N/A | N/A | 10660 | 10679 | ATAGTGCTGCTGCCAGAGTC | 88 | 2101 |
| 1104260 | N/A | N/A | 10779 | 10798 | CTCTCCCATGCCCGGCTTCC | 112 | 2102 |
| 1104276 | N/A | N/A | 10983 | 11002 | CATGGCCTGGCCTTGAGAAT | 31 | 2103 |
| 1104292 | N/A | N/A | 11115 | 11134 | CCCCTTAGAACAGCCTATGG | 111 | 2104 |

TABLE 28-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104308 | N/A | N/A | 11156 | 11175 | TGTGTATTAGGATCCCATCT | 41 | 2105 |
| 1104324 | N/A | N/A | 11234 | 11253 | AGTGAAAGCTACTAACTTTA | 78 | 2106 |
| 1104340 | N/A | N/A | 11326 | 11345 | AATCCCCTCTTCCCATTCCC | 105 | 2107 |
| 1104356 | N/A | N/A | 11396 | 11415 | CTGGCGAGTGGTAAGCTGCT | 91 | 2108 |
| 1104372 | N/A | N/A | 11535 | 11554 | TCCACCACCACGAGGCTGTG | 101 | 2109 |

TABLE 29

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 8 | 517 |
| 1103157 | 158 | 177 | 3606 | 3625 | GAGGCGGGTGCCAGGACCCA | 45 | 2110 |
| 1103173 | 409 | 428 | 3857 | 3876 | CGCAGCTCAGCCTGGTAGAC | 97 | 2111 |
| 1103189 | 636 | 655 | 5225 | 5244 | TCTCCTCCTCCAGCGACTCA | 92 | 2112 |
| 1103205 | 843 | 862 | N/A | N/A | CTGTCAGGTCTGCAAACTTG | 74 | 2113 |
| 1103221 | 1263 | 1282 | 10877 | 10896 | TCTTGAGGTGGCCTTCTGAC | 104 | 2114 |
| 1103237 | 1399 | 1418 | 11688 | 11707 | TTCTGCTCGGGCCCCTCATG | 75 | 2115 |
| 1103253 | 1544 | 1563 | 11833 | 11852 | GGTGGGTGCCGTCTGGCAGG | 34 | 2116 |
| 1103269 | 1683 | 1702 | 11972 | 11991 | TGGAGGGCGATGTAGTAGGT | 58 | 2117 |
| 1103285 | 1800 | 1819 | 12089 | 12108 | GTCTGAGTCTCAGTTTTCCT | 25 | 2118 |
| 1103301 | 1872 | 1891 | 12161 | 12180 | ACCTCATAAAAACCAAAAGA | 116 | 2119 |
| 1103317 | 1893 | 1912 | 12182 | 12201 | TAGGCAGCATAGGGATATCC | 101 | 2120 |
| 1103333 | 2110 | 2129 | 12399 | 12418 | GGACTGAGACACTTGAGTCA | 96 | 2121 |
| 1103349 | 2348 | 2367 | 12637 | 12656 | GCGCCATCCCAATTGCCTCC | 98 | 2122 |
| 1103365 | 2446 | 2465 | 12735 | 12754 | CTGTTTCAGCATCTTCAAGA | 41 | 2123 |
| 1103381 | 2493 | 2512 | 12782 | 12801 | TGGGACAAAGTCATGCCCTG | 105 | 2124 |
| 1103397 | 2530 | 2549 | 12819 | 12838 | GCCTGGTATGACACAGCAAG | 85 | 2125 |
| 1103413 | 2697 | 2716 | 12986 | 13005 | CTACCTAGAATACTGGGTAC | 110 | 2126 |
| 1103429 | 2753 | 2772 | 13042 | 13061 | TGAGCCAGTGTCTTCACTTT | 70 | 2127 |
| 1103445 | 3015 | 3034 | 13304 | 13323 | AGCAGTGCCCTGAAGATTAG | 86 | 2128 |
| 1103461 | N/A | N/A | 8748 | 8767 | TTTCCCCGTCTTTGGTGCTT | 77 | 2129 |
| 1103477 | N/A | N/A | 8824 | 8843 | CCATTTACAATCTGGTGAGC | 61 | 2130 |
| 1103493 | N/A | N/A | 8982 | 9001 | TCCTGGGAAAATGACGCAGT | 114 | 2131 |
| 1103509 | N/A | N/A | 9142 | 9161 | TCCCAGTGACAGGAAGAGGT | 105 | 2132 |
| 1103525 | N/A | N/A | 9245 | 9264 | ATCCTCTGAACTGAGTCAGC | 93 | 2133 |
| 1103541 | N/A | N/A | 9292 | 9311 | GAACATAAAACTTTATTCAC | 110 | 2134 |

TABLE 29-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103557 | N/A | N/A | 8403 | 8422 | TCCAGTGCCCTTCCCACGAG | 104 | 2135 |
| 1103573 | N/A | N/A | 8542 | 8561 | TAGAAGTACCCTGGTATGAT | 110 | 2136 |
| 1103589 | N/A | N/A | 8728 | 8747 | TTGCCCCCTGTAGTGACAAG | 103 | 2137 |
| 1103605 | N/A | N/A | 4005 | 4024 | ATTCAGCCCCTTCTGCTCAC | 106 | 2138 |
| 1103621 | V/A | N/A | 4213 | 4232 | CTGCTTTCCCCAGTAGGGAG | 94 | 2139 |
| 1103637 | N/A | N/A | 4367 | 4386 | CTTCACCCCAGAATCCAATC | 124 | 2140 |
| 1103653 | N/A | N/A | 4423 | 4442 | TGGCAGGCAGTCACCTGTGC | 130 | 2141 |
| 1103669 | N/A | N/A | 4577 | 4596 | GAAGGCACACATGCATGTCC | 103 | 2142 |
| 1103685 | N/A | N/A | 4665 | 4684 | ACCTGCTTCTGCTCACACAG | 96 | 2143 |
| 1103701 | N/A | N/A | 4858 | 4877 | TTCTGAGGACACTTGAATAC | 128 | 2144 |
| 1103717 | N/A | N/A | 5166 | 5185 | TCTGCTTCCTGGAGTGGCAG | 111* | 2145 |
| 1103733 | N/A | N/A | 5364 | 5383 | TCTCTCCTCTCTCTGAGTGT | 100 | 2146 |
| 1103749 | N/A | N/A | 5440 | 5459 | CTCTTGTCTCTTTCCGTCTC | 105 | 2147 |
| 1103765 | N/A | N/A | 5535 | 5554 | AAGCGGTACCAGGGCTCAGG | 62 | 2148 |
| 1103781 | N/A | N/A | 5810 | 5829 | TATTCTCCCAGCTTCCTCCA | 112 | 2149 |
| 1103797 | N/A | N/A | 5888 | 5907 | TTTTGAAAGCAATAGTGCCT | 94 | 2150 |
| 1103813 | N/A | N/A | 5951 | 5970 | TAGAACAGAACAGTATCAGC | 92 | 2151 |
| 1103829 | N/A | N/A | 5989 | 6008 | TACTTCATAGTAAGGTAATC | 112 | 2152 |
| 1103845 | N/A | N/A | 6144 | 6163 | CCCAAAACAGACTGGCAGAG | 79 | 2153 |
| 1103861 | N/A | N/A | 6216 | 6235 | ATATCACACCTTCCAGGTCA | 87 | 2154 |
| 1103877 | N/A | N/A | 6273 | 6292 | ACATATAAGCTCTGAGCTGT | 105 | 2155 |
| 1103893 | N/A | N/A | 6333 | 6352 | CGTGCCTGTCCTGCCTAGCC | 90 | 2156 |
| 1103909 | N/A | N/A | 6457 | 6476 | ACACTCCTCAGCTAGGTGCC | 87 | 2157 |
| 1103925 | N/A | N/A | 6536 | 6555 | TTCTCCCCTGCCTGCAGGGA | 120 | 2158 |
| 1103941 | N/A | N/A | 6978 | 6997 | TGAATGAACAGTGCCACAGA | 112 | 2159 |
| 1103957 | N/A | N/A | 7107 | 7126 | GCACCCCAGTTAACCCCAGG | 93 | 2160 |
| 1103973 | N/A | N/A | 7341 | 7360 | CCCGTCCCCGTCCTGCCCTG | 98 | 2161 |
| 1103989 | N/A | N/A | 7476 | 7495 | AGGTTTCGAGGCCCGGCCCC | 93 | 2162 |
| 1104005 | N/A | N/A | 7851 | 7870 | GATCTGCACACAAGGCTGAA | 99 | 2163 |
| 1104021 | N/A | N/A | 7961 | 7980 | GAGGCCTAATCAATATTGGT | 111 | 2164 |
| 1104037 | N/A | N/A | 8047 | 8066 | GATGGGTGAGGTGAGGAGTC | 40 | 2165 |
| 1104053 | N/A | N/A | 8118 | 8137 | CGCATGTCTATCTGAAGGAA | 90 | 2166 |
| 1104069 | N/A | N/A | 8325 | 8344 | TCCTGAAAGAAAGCAGAGGG | 114 | 2167 |
| 1104085 | N/A | N/A | 9386 | 9405 | GTAAAAAGTAATTTAGCTCC | 127 | 2168 |
| 1104101 | N/A | N/A | 9428 | 9447 | AATTTTGTTCCTTAGCTAAG | 125 | 2169 |
| 1104117 | N/A | N/A | 9460 | 9479 | TGGTCCTAAATATTCTAGTC | 74 | 2170 |

TABLE 29-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104133 | N/A | N/A | 9516 | 9535 | GTCAGCCTGGTTAGCCTTTC | 30 | 2171 |
| 1104149 | N/A | N/A | 9541 | 9560 | GGATTTGGCAGTATTACCTC | 52 | 2172 |
| 1104165 | N/A | N/A | 9565 | 9584 | GCTTTAGTGACCTGTGACTA | 43 | 2173 |
| 1104181 | N/A | N/A | 9589 | 9608 | TACTTCTCTCTGCCATTTAT | 75 | 2174 |
| 1104197 | N/A | N/A | 9678 | 9697 | CAATTAACTAAAATAAAGGC | 130 | 2175 |
| 1104213 | N/A | N/A | 9828 | 9847 | GGATCAGGAGACCAGAGCTC | 118 | 2176 |
| 1104229 | N/A | N/A | 10564 | 10583 | ACCCAGCACGGTATTGAAAT | 105 | 2177 |
| 1104245 | N/A | N/A | 10670 | 10689 | CCAAATCCCAATAGTGCTGC | 80 | 2178 |
| 1104261 | N/A | N/A | 10782 | 10801 | ATCCTCTCCCATGCCCGGCT | 87 | 2179 |
| 1104277 | N/A | N/A | 11006 | 11025 | TGTGCCAGCCCCAGGCTTTC | 125 | 2180 |
| 1104293 | N/A | N/A | 11119 | 11138 | GGCTCCCCTTAGAACAGCCT | 115 | 2181 |
| 1104309 | N/A | N/A | 11158 | 11177 | AGTGTGTATTAGGATCCCAT | 18 | 2182 |
| 1104325 | N/A | N/A | 11235 | 11254 | AAGTGAAAGCTACTAACTTT | 102 | 2183 |
| 1104341 | N/A | N/A | 11327 | 11346 | AAATCCCCTCTTCCCATTCC | 110 | 2184 |
| 1104357 | N/A | N/A | 11428 | 11447 | AGATAACACTGGGAAAGCAT | 97 | 2185 |
| 1104373 | N/A | N/A | 11537 | 11556 | GGTCCACCACCACGAGGCTG | 108 | 2186 |

TABLE 30

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 7 | 517 |
| 1103158 | 206 | 225 | 3654 | 3673 | GGAGAAATCCACCCGGGTCG | 155 | 2187 |
| 1103174 | 410 | 429 | 3858 | 3877 | TCGCAGCTCAGCCTGGTAGA | 127 | 2188 |
| 1103190 | 648 | 667 | 5237 | 5256 | TCAAGAACCGGATCTCCTCC | 63 | 2189 |
| 1103206 | 926 | 945 | 7283 | 7302 | GGTCAAGGACTGCAACTGGC | 96 | 2190 |
| 1103222 | 1270 | 1289 | 10884 | 10903 | ATGTTCCTCTTGAGGTGGCC | 86 | 2191 |
| 1103238 | 1400 | 1419 | 11689 | 11708 | CTTCTGCTCGGGCCCCTCAT | 59 | 2192 |
| 1103254 | 1573 | 1592 | 11862 | 11881 | TTCTTGTTAGTTGGAGTTGC | 33 | 2193 |
| 1103270 | 1686 | 1705 | 11975 | 11994 | ATGTGGAGGGCGATGTAGTA | 49 | 2194 |
| 1103286 | 1809 | 1828 | 12098 | 12117 | CCCTTTCCTGTCTGAGTCTC | 72 | 2195 |
| 1103302 | 1873 | 1892 | 12162 | 12181 | CACCTCATAAAAACCAAAAG | 100 | 2196 |
| 1103318 | 1996 | 2015 | 12285 | 12304 | GAACAACCCTCTGAGCTGGG | 57 | 2197 |
| 1103334 | 2124 | 2143 | 12413 | 12432 | ATGGCAGCTCAGGTGGACTG | 54 | 2198 |
| 1103350 | 2364 | 2383 | 12653 | 12672 | CCTACTTGTATGCCTAGCGC | 75 | 2199 |
| 1103366 | 2447 | 2466 | 12736 | 12755 | CCTGTTTCAGCATCTTCAAG | 42 | 2200 |

TABLE 30-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103382 | 2494 | 2513 | 12783 | 12802 | ATGGGACAAAGTCATGCCCT | 98 | 2201 |
| 1103398 | 2567 | 2586 | 12856 | 12875 | AAGAAGCAGCAGTCCCAGGG | 75 | 2202 |
| 1103414 | 2700 | 2719 | 2989 | 13008 | GCACTACCTAGAATACTGGG | 76 | 2203 |
| 1103430 | 2754 | 2773 | 13043 | 13062 | ATGAGCCAGTGTCTTCACTT | 37 | 2204 |
| 1103446 | 3017 | 3036 | 13306 | 13325 | GCAGCAGTGCCCTGAAGATT | 29 | 2205 |
| 1103462 | N/A | N/A | 8749 | 8768 | TTTTCCCCGTCTTTGGTGCT | 56 | 2206 |
| 1103478 | N/A | N/A | 8825 | 8844 | TCCATTTACAATCTGGTGAG | 41 | 2207 |
| 1103494 | N/A | N/A | 8983 | 9002 | TTCCTGGGAAAATGACGCAG | 97 | 2208 |
| 1103510 | N/A | N/A | 9144 | 9163 | CCTCCCAGTGACAGGAAGAG | 104 | 2209 |
| 1103526 | N/A | N/A | 9246 | 9265 | AATCCTCTGAACTGAGTCAG | 54 | 2210 |
| 1103542 | N/A | N/A | 9293 | 9312 | GGAACATAAAACTTTATTCA | 69 | 2211 |
| 1103558 | N/A | N/A | 8405 | 8424 | ACTCCAGTGCCCTTCCCACG | 27 | 2212 |
| 1103574 | N/A | N/A | 8543 | 8562 | CTAGAAGTACCCTGGTATGA | 95 | 2213 |
| 1103590 | N/A | N/A | 8730 | 8749 | TTTTGCCCCCTGTAGTGACA | 67 | 2214 |
| 1103606 | N/A | N/A | 4038 | 4057 | TCCCTGAGACTTCTCGGGCA | 110 | 2215 |
| 1103622 | N/A | N/A | 4214 | 4233 | ACTGCTTTCCCCAGTAGGGA | 77 | 2216 |
| 1103638 | N/A | N/A | 4371 | 4390 | CTTTCTTCACCCCAGAATCC | 139 | 2217 |
| 1103654 | N/A | N/A | 4424 | 4443 | GTGGCAGGCAGTCACCTGTG | 83 | 2218 |
| 1103670 | N/A | N/A | 4578 | 4597 | TGAAGGCACACATGCATGTC | 105 | 2219 |
| 1103686 | N/A | N/A | 4666 | 4685 | CACCTGCTTCTGCTCACACA | 158 | 2220 |
| 1103702 | N/A | N/A | 4960 | 4979 | CCTGACCTGTCTATAGGCAG | 92* | 2221 |
| 1103718 | N/A | N/A | 5167 | 5186 | ATCTGCTTCCTGGAGTGGCA | 102* | 2222 |
| 1103734 | N/A | N/A | 5365 | 5384 | TTCTCTCCTCTCTCTGAGTG | 102 | 2223 |
| 1103750 | N/A | N/A | 5442 | 5461 | CTCTCTTGTCTCTTTCCGTC | 69 | 2224 |
| 1103766 | N/A | N/A | 5536 | 5555 | GAAGCGGTACCAGGGCTCAG | 95 | 2225 |
| 1103782 | N/A | N/A | 5811 | 5830 | ATATTCTCCCAGCTTCCTCC | 92 | 2226 |
| 1103798 | N/A | N/A | 5893 | 5912 | GGTACTTTTGAAAGCAATAG | 47 | 2227 |
| 1103814 | N/A | N/A | 5955 | 5974 | GGCTTAGAACAGAACAGTAT | 87 | 2228 |
| 1103830 | N/A | N/A | 5996 | 6015 | CAGCACCTACTTCATAGTAA | 54 | 2229 |
| 1103846 | N/A | N/A | 6156 | 6175 | GAGGCTCAGTAACCCAAAAC | 60 | 2230 |
| 1103862 | N/A | N/A | 6217 | 6236 | AATATCACACCTTCCAGGTC | 130 | 2231 |
| 1103878 | N/A | N/A | 6275 | 6294 | CTACATATAAGCTCTGAGCT | 127 | 2232 |
| 1103894 | N/A | N/A | 6369 | 6388 | AGGAATGGCCCTCCCTTCTT | 93 | 2233 |
| 1103910 | N/A | N/A | 6458 | 6477 | CACACTCCTCAGCTAGGTGC | 75 | 2234 |
| 1103926 | N/A | N/A | 6541 | 6560 | GCCCTTTCTCCCCTGCCTGC | 106 | 2235 |
| 1103942 | N/A | N/A | 6980 | 6999 | AATGAATGAACAGTGCCACA | 113 | 2236 |

TABLE 30-continued

Reduction of GFAP RNA by 5-10-5 MCE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103958 | N/A | N/A | 7114 | 7133 | GTGAGCAGCACCCCAGTTAA | 117 | 2237 |
| 1103974 | N/A | N/A | 7345 | 7364 | TCCGCCCGTCCCCGTCCTGC | 119 | 2238 |
| 1103990 | N/A | N/A | 7477 | 7496 | GAGGTTTCGAGGCCCGGCCC | 129 | 2239 |
| 1104006 | N/A | N/A | 7852 | 7871 | GGATCTGCACACAAGGCTGA | 112 | 2240 |
| 1104022 | N/A | N/A | 7962 | 7981 | TGAGGCCTAATCAATATTGG | 96 | 2241 |
| 1104038 | N/A | N/A | 8050 | 8069 | AGAGATGGGTGAGGTGAGGA | 36 | 2242 |
| 1104054 | N/A | N/A | 8140 | 8159 | CTTGAGTGTTATCTGGGAGG | 61 | 2243 |
| 1104070 | N/A | N/A | 8336 | 8355 | GGGAATGGTGATCCTGAAAG | 53 | 2244 |
| 1104086 | N/A | N/A | 9388 | 9407 | AAGTAAAAAGTAATTTAGCT | 87 | 2245 |
| 1104102 | N/A | N/A | 9429 | 9448 | GAATTTTGTTCCTTAGCTAA | 80 | 2246 |
| 1104118 | N/A | N/A | 9477 | 9496 | GAGACATGCATATCTAGTGG | 23 | 2247 |
| 1104134 | N/A | N/A | 9518 | 9537 | TAGTCAGCCTGGTTAGCCTT | 63 | 2248 |
| 1104150 | N/A | N/A | 9547 | 9566 | TATCTAGGATTTGGCAGTAT | 58 | 2249 |
| 1104166 | N/A | N/A | 9567 | 9586 | GTGCTTTAGTGACCTGTGAC | 25 | 2250 |
| 1104182 | N/A | N/A | 9591 | 9610 | CCTACTTCTCTCTGCCATTT | 75 | 2251 |
| 1104198 | N/A | N/A | 9679 | 9698 | ACAATTAACTAAAATAAAGG | 95 | 2252 |
| 1104214 | N/A | N/A | 10003 | 10022 | GTAATCCCCTTACTCGGGAG | 84 | 2253 |
| 1104230 | N/A | N/A | 10565 | 10584 | AACCCAGCACGGTATTGAAA | 117 | 2254 |
| 1104246 | N/A | N/A | 10671 | 10690 | CCCAAATCCCAATAGTGCTG | 59 | 2255 |
| 1104262 | N/A | N/A | 10786 | 10805 | AGCCATCCTCTCCCATGCCC | 130 | 2256 |
| 1104278 | N/A | N/A | 11010 | 11029 | TCTATGTGCCAGCCCCAGGC | 83 | 2257 |
| 1104294 | N/A | N/A | 11120 | 11139 | AGGCTCCCCTTAGAACAGCC | 75 | 2258 |
| 1104310 | N/A | N/A | 11159 | 11178 | GAGTGTGTATTAGGATCCCA | 18 | 2259 |
| 1104326 | N/A | N/A | 11237 | 11256 | GGAAGTGAAAGCTACTAACT | 46 | 2260 |
| 1104342 | N/A | N/A | 11329 | 11348 | CCAAATCCCCTCTTCCCATT | 81 | 2261 |
| 1104358 | N/A | N/A | 11430 | 11449 | TGAGATAACACTGGGAAAGC | 89 | 2262 |
| 1104374 | N/A | N/A | 11543 | 11562 | ACCCCAGGTCCACCACCACG | 101 | 2263 |

TABLE 31

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 7 | 517 |
| 1103159 | 218 | 237 | 3666 | 3685 | TGCCCCAGCCAGGGAGAAAT | 93 | 2264 |
| 1103175 | 411 | 430 | 3859 | 3878 | CTCGCAGCTCAGCCTGGTAG | 69 | 2265 |
| 1103191 | 652 | 671 | 5241 | 5260 | TTCCTCAAGAACCGGATCTC | 79 | 2266 |

TABLE 31-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103207 | 930 | 949 | 7287 | 7306 | CGCAGGTCAAGGACTGCAAC | 84 | 2267 |
| 1103223 | 1271 | 1290 | 10885 | 10904 | GATGTTCCTCTTGAGGTGGC | 94 | 2268 |
| 1103239 | 1401 | 1420 | 11690 | 11709 | GCTTCTGCTCGGGCCCCTCA | 52 | 2269 |
| 1103255 | 1575 | 1594 | 11864 | 11883 | GTTTCTTGTTAGTTGGAGTT | 19 | 2270 |
| 1103271 | 1687 | 1706 | 11976 | 11995 | GATGTGGAGGGCGATGTAGT | 69 | 2271 |
| 1103287 | 1811 | 1830 | 12100 | 12119 | TTCCCTTTCCTGTCTGAGTC | 56 | 2272 |
| 1103303 | 1874 | 1893 | 12163 | 12182 | CCACCTCATAAAAACCAAAA | 89 | 2273 |
| 1103319 | 1997 | 2016 | 12286 | 12305 | AGAACAACCCTCTGAGCTGG | 61 | 2274 |
| 1103335 | 2183 | 2202 | 12472 | 12491 | CAAGTGCTGAGAATCAAGCT | 87 | 2275 |
| 1103351 | 2398 | 2417 | 12687 | 12706 | TCCAGAGGCCAAGTGCAACT | 57 | 2276 |
| 1103367 | 2448 | 2467 | 12737 | 12756 | TCCTGTTTCAGCATCTTCAA | 61 | 2277 |
| 1103383 | 2495 | 2514 | 12784 | 12803 | AATGGGACAAAGTCATGCCC | 88 | 2278 |
| 1103399 | 2629 | 2648 | 12918 | 12937 | AAAAGCAGCCGGTCACTATG | 100 | 2279 |
| 1103415 | 2703 | 2722 | 12992 | 13011 | AGGGCACTACCTAGAATACT | 71 | 2280 |
| 1103431 | 2789 | 2808 | 13078 | 13097 | CAGCCCTGAGCACCCGGCCT | 106 | 2281 |
| 1103447 | 3019 | 3038 | 13308 | 13327 | CAGCAGCAGTGCCCTGAAGA | 38 | 2282 |
| 1103463 | N/A | N/A | 8750 | 8769 | ATTTTCCCCGTCTTTGGTGC | 65 | 2283 |
| 1103479 | N/A | N/A | 8855 | 8874 | GGCAGGCAGCTAACCGCGAG | 80 | 2284 |
| 1103495 | N/A | N/A | 8984 | 9003 | GTTCCTGGGAAAATGACGCA | 89 | 2285 |
| 1103511 | N/A | N/A | 9146 | 9165 | GCCCTCCCAGTGACAGGAAG | 96 | 2286 |
| 1103527 | N/A | N/A | 9249 | 9268 | AAGAATCCTCTGAACTGAGT | 85 | 2287 |
| 1103543 | N/A | N/A | 9294 | 9313 | GGGAACATAAAACTTTATTC | 42 | 2288 |
| 1103559 | N/A | N/A | 8407 | 8426 | GGACTCCAGTGCCCTTCOCA | 90 | 2289 |
| 1103575 | N/A | N/A | 8544 | 8563 | CCTAGAAGTACCCTGGTATG | 64 | 2290 |
| 1103591 | N/A | N/A | 8732 | 8751 | GCTTTTGCCCCCTGTAGTGA | 36 | 2291 |
| 1103607 | N/A | N/A | 4039 | 4058 | CTCCCTGAGACTTCTCGGGC | 129 | 2292 |
| 1103623 | N/A | N/A | 4216 | 4235 | GCACTGCTTTCCCCAGTAGG | 88 | 2293 |
| 1103639 | N/A | N/A | 4372 | 4391 | ACTTTCTTCACCCCAGAATC | 101 | 2294 |
| 1103655 | N/A | N/A | 4456 | 4475 | AGTCAAAGTAACTTGATGGG | 90 | 2295 |
| 1103671 | N/A | N/A | 4579 | 4598 | TTGAAGGCACACATGCATGT | 102 | 2296 |
| 1103687 | N/A | N/A | 4728 | 4747 | AGGATGAGCAGATGTGGGCT | 77 | 2297 |
| 1103703 | N/A | N/A | 4961 | 4980 | CCCTGACCTGTCTATAGGCA | 105* | 2298 |
| 1103719 | N/A | N/A | 5169 | 5188 | TCATCTGCTTCCTGGAGTGG | 49* | 2299 |
| 1103735 | N/A | N/A | 5366 | 5385 | TTTCTCTCCTCTCTCTGAGT | 95 | 2300 |
| 1103751 | N/A | N/A | 5446 | 5465 | AATGCTCTCTTGTCTCTTTC | 83 | 2301 |
| 1103767 | N/A | N/A | 5537 | 5556 | AGAAGCGGTACCAGGGCTCA | 100 | 2302 |

TABLE 31-continued

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| Reduction of GFAP RNA by 5-10-5 MOE gapmers with mixed PO/PS internucleoside linkages in U251 cells | | | | | | | |
| 1103783 | N/A | N/A | 5830 | 5849 | AGTCAGTCACCTGGAGAGGA | 79 | 2303 |
| 1103799 | N/A | N/A | 5898 | 5917 | TAATGGGTACTTTTGAAAGC | 100 | 2304 |
| 1103815 | N/A | N/A | 5956 | 5975 | GGGCTTAGAACAGAACAGTA | 74 | 2305 |
| 1103831 | N/A | N/A | 5997 | 6016 | ACAGCACCTACTTCATAGTA | 113 | 2306 |
| 1103847 | N/A | N/A | 6158 | 6177 | TAGAGGCTCAGTAACCCAAA | 74 | 2307 |
| 1103863 | N/A | N/A | 6218 | 6237 | CAATATCACACCTTCCAGGT | 72 | 2308 |
| 1103879 | N/A | N/A | 6277 | 6296 | CACTACATATAAGCTCTGAG | 93 | 2309 |
| 1103895 | N/A | N/A | 6370 | 6389 | TAGGAATGGCCCTCCCTTCT | 91 | 2310 |
| 1103911 | N/A | N/A | 6461 | 6480 | ACTCACACTCCTCAGCTAGG | 100 | 2311 |
| 1103927 | N/A | N/A | 6546 | 6565 | TAATAGCCCTTTCTCCCCTG | 93 | 2312 |
| 1103943 | N/A | N/A | 6982 | 7001 | CGAATGAATGAACAGTGCCA | 108 | 2313 |
| 1103959 | N/A | N/A | 7120 | 7139 | AGGGAGGTGAGCAGCACCCC | 103 | 2314 |
| 1103975 | N/A | N/A | 7347 | 7366 | GCTCCGCCCGTCCCCGTCCT | 66 | 2315 |
| 1103991 | N/A | N/A | 7478 | 7497 | GGAGGTTTCGAGGCCCGGCC | 117 | 2316 |
| 1104007 | N/A | N/A | 7853 | 7872 | GGGATCTGCACACAAGGCTG | 49 | 2317 |
| 1104023 | N/A | N/A | 7963 | 7982 | TTGAGGCCTAATCAATATTG | 110 | 2318 |
| 1104039 | N/A | N/A | 8052 | 8071 | GAAGAGATGGGTGAGGTGAG | 36 | 2319 |
| 1104055 | N/A | N/A | 8193 | 8212 | CTTTTTCCCCAGCAGCCAAC | 125 | 2320 |
| 1104071 | N/A | N/A | 9325 | 9344 | TCACATTCACTAATATTTAA | 74 | 2321 |
| 1104087 | N/A | N/A | 9389 | 9408 | CAAGTAAAAAGTAATTTAGC | 120 | 2322 |
| 1104103 | N/A | N/A | 9433 | 9452 | AGAGGAATTTTGTTCCTTAG | 98 | 2323 |
| 1104119 | N/A | N/A | 9481 | 9500 | TCCTGAGACATGCATATCTA | 82 | 2324 |
| 1104135 | N/A | N/A | 9520 | 9539 | ACTAGTCAGCCTGGTTAGCC | 66 | 2325 |
| 1104151 | N/A | N/A | 9549 | 9568 | ACTATCTAGGATTTGGCAGT | 36 | 2326 |
| 1104167 | N/A | N/A | 9569 | 9588 | CTGTGCTTTAGTGACCTGTG | 42 | 2327 |
| 1104183 | N/A | N/A | 9636 | 9655 | AGTGCTCAATACACATAGGT | 58 | 2328 |
| 1104199 | N/A | N/A | 9680 | 9699 | GACAATTAACTAAAATAAAG | 87 | 2329 |
| 1104215 | N/A | N/A | 0131 | 10150 | ACTCCGTCGAAAGCAGGCAA | 91 | 2330 |
| 1104231 | N/A | N/A | 10566 | 10585 | AAACCCAGCACGGTATTGAA | 71 | 2331 |
| 1104247 | N/A | N/A | 0694 | 10713 | TCTTCCAAACGGGCTGGAGA | 98 | 2332 |
| 1104263 | N/A | N/A | 10790 | 10809 | CATGAGCCATCCTCTCCCAT | 70 | 2333 |
| 1104279 | N/A | N/A | 11023 | 11042 | TTGCTGGGAACCTTCTATGT | 97 | 2334 |
| 1104295 | N/A | N/A | 11121 | 11140 | AAGGCTCCCCTTAGAACAGC | 64 | 2335 |
| 1104311 | N/A | N/A | 11160 | 11179 | AGAGTGTGTATTAGGATCCC | 31 | 2336 |
| 1104327 | N/A | N/A | 11242 | 11261 | GAGTTGGAAGTGAAAGCTAC | 67 | 2337 |
| 1104343 | N/A | N/A | 11342 | 11361 | CGTGGCGGATACGCCAAATC | 96 | 2338 |
| 1104359 | N/A | N/A | 11431 | 11450 | GTGAGATAACACTGGGAAAG | 65 | 2339 |

TABLE 31-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104375 | N/A | N/A | 11552 | 11571 | TTCACACAGACCCCAGGTCC | 96 | 2340 |

TABLE 32

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 6 | 517 |
| 1103160 | 221 | 240 | 3669 | 3688 | GAGTGCCCCAGCCAGGGAGA | 119 | 2341 |
| 1103176 | 442 | 461 | 3890 | 3909 | GCGGTGAGTTGATCGAGCCG | 86 | 2342 |
| 1103192 | 653 | 672 | 5242 | 5261 | CTTCCTCAAGAACCGGATCT | 81 | 2343 |
| 1103208 | 932 | 951 | 7289 | 7308 | GTCGCAGGTCAAGGACTGCA | 100 | 2344 |
| 1103224 | 1293 | 1312 | 10907 | 10926 | GCATCTCCACGGTCTTCACC | 85 | 2345 |
| 1103240 | 1403 | 1422 | 11692 | 11711 | CTGCTTCTGCTCGGGCCCCT | 80 | 2346 |
| 1103256 | 1577 | 1596 | 11866 | 11885 | GAGTTTCTTGTTAGTTGGAG | 9 | 2347 |
| 1103272 | 1700 | 1719 | 11989 | 12008 | AACAGGAATCAGGGATGTGG | 35 | 2348 |
| 1103288 | 1836 | 1855 | 12125 | 12144 | CCAGGGCTACCTTGTCTGTG | 90 | 2349 |
| 1103304 | 1878 | 1897 | 12167 | 12186 | TATCCCACCTCATAAAAACC | 88 | 2350 |
| 1103320 | 2001 | 2020 | 12290 | 12309 | TAGGAGAACAACCCTCTGAG | 62 | 2351 |
| 1103336 | 2185 | 2204 | 12474 | 12493 | CCCAAGTGCTGAGAATCAAG | 53 | 2352 |
| 1103352 | 2400 | 2419 | 12689 | 12708 | AATCCAGAGGCCAAGTGCAA | 95 | 2353 |
| 1103368 | 2452 | 2471 | 12741 | 12760 | TCTCTCCTGTTTCAGCATCT | 22 | 2354 |
| 1103384 | 2496 | 2515 | 12785 | 12804 | AAATGGGACAAAGTCATGCC | 98 | 2355 |
| 1103400 | 2637 | 2656 | 12926 | 12945 | GCTTAGGGAAAAGCAGCCGG | 51 | 2356 |
| 1103416 | 2704 | 2723 | 12993 | 13012 | TAGGGCACTACCTAGAATAC | 75 | 2357 |
| 1103432 | 2791 | 2810 | 13080 | 13099 | GTCAGCCCTGAGCACCCGGC | 116 | 2358 |
| 1103448 | 3021 | 3040 | 13310 | 13329 | GGCAGCAGCAGTGCCCTGAA | 38 | 2359 |
| 1103464 | N/A | N/A | 8752 | 8771 | TGATTTTCCCCGTCTTTGGT | 58 | 2360 |
| 1103480 | N/A | N/A | 8866 | 8885 | CGTGTCTGAGAGGCAGGCAG | 76 | 2361 |
| 1103496 | N/A | N/A | 8989 | 9008 | CTGCAGTTCCTGGGAAAATG | 70 | 2362 |
| 1103512 | N/A | N/A | 9147 | 9166 | GGCCCTCCCAGTGACAGGAA | 68 | 2363 |
| 1103528 | N/A | N/A | 9250 | 9269 | GAAGAATCCTCTGAACTGAG | 64 | 2364 |
| 1103544 | N/A | N/A | 9295 | 9314 | AGGGAACATAAAACTTTATT | 57 | 2365 |
| 1103560 | N/A | N/A | 8408 | 8427 | AGGACTCCAGTGCCCTTCCC | 57 | 2366 |
| 1103576 | N/A | N/A | 8546 | 8565 | CACCTAGAAGTACCCTGGTA | 101 | 2367 |
| 1103592 | N/A | N/A | 8734 | 8753 | GTGCTTTTGCCCCCTGTAGT | 43 | 2368 |

TABLE 32-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103608 | N/A | N/A | 4040 | 4059 | CCTCCCTGAGACTTCTCGGG | 86 | 2369 |
| 1103624 | N/A | N/A | 4217 | 4236 | TGCACTGCTTTCCCCAGTAG | 102 | 2370 |
| 1103640 | N/A | N/A | 4373 | 4392 | CACTTTCTTCACCCCAGAAT | 135 | 2371 |
| 1103656 | N/A | N/A | 4465 | 4484 | AGCTGTGCAAGTCAAAGTAA | 80 | 2372 |
| 1103672 | N/A | N/A | 4584 | 4603 | TGCACTTGAAGGCACACATG | 59 | 2373 |
| 1103688 | N/A | N/A | 4729 | 4748 | GAGGATGAGCAGATGTGGGC | 65 | 2374 |
| 1103704 | N/A | N/A | 4962 | 4981 | TCCCTGACCTGTCTATAGGC | 95* | 2375 |
| 1103720 | N/A | N/A | 5170 | 5189 | TTCATCTGCTTCCTGGAGTG | 72* | 2376 |
| 1103736 | N/A | N/A | 5381 | 5400 | ACCTGCCAATCTCTGTTTCT | 94 | 2377 |
| 1103752 | N/A | N/A | 5447 | 5466 | GAATGCTCTCTTGTCTCTTT | 54 | 2378 |
| 1103768 | N/A | N/A | 5541 | 5560 | TGAGAGAAGCGGTACCAGGG | 79 | 2379 |
| 1103784 | N/A | N/A | 5832 | 5851 | AAAGTCAGTCACCTGGAGAG | 87 | 2380 |
| 1103800 | N/A | N/A | 5907 | 5926 | CAGTAATAATAATGGGTACT | 67 | 2381 |
| 1103816 | N/A | N/A | 5957 | 5976 | AGGGCTTAGAACAGAACAGT | 50 | 2382 |
| 1103832 | N/A | N/A | 6005 | 6024 | GTCAAAGAACAGCACCTACT | 121 | 2383 |
| 1103848 | N/A | N/A | 6160 | 6179 | GGTAGAGGCTCAGTAACCCA | 68 | 2384 |
| 1103864 | N/A | N/A | 6219 | 6238 | TCAATATCACACCTTCCAGG | 80 | 2385 |
| 1103880 | N/A | N/A | 6278 | 6297 | ACACTACATATAAGCTCTGA | 109 | 2386 |
| 1103896 | N/A | N/A | 6382 | 6401 | TCTGTCCTCCACTAGGAATG | 120 | 2387 |
| 1103912 | N/A | N/A | 6462 | 6481 | CACTCACACTCCTCAGCTAG | 85 | 2388 |
| 1103928 | N/A | N/A | 6554 | 6573 | CTGGGTTCTAATAGCCCTTT | 77 | 2389 |
| 1103944 | N/A | N/A | 6983 | 7002 | GCGAATGAATGAACAGTGCC | 75 | 2390 |
| 1103960 | N/A | N/A | 7122 | 7141 | TCAGGGAGGTGAGCAGCACC | 111 | 2391 |
| 1103976 | N/A | N/A | 7354 | 7373 | CGTCCCTGCTCCGCCCGTCC | 93 | 2392 |
| 1103992 | N/A | N/A | 7504 | 7523 | TCCCGCGGAGCCCCGACCCG | 90 | 2393 |
| 1104008 | N/A | N/A | 7857 | 7876 | GGAAGGGATCTGCACACAAG | 59 | 2394 |
| 1104024 | N/A | N/A | 7965 | 7984 | CCTTGAGGCCTAATCAATAT | 80 | 2395 |
| 1104040 | N/A | N/A | 8053 | 8072 | AGAAGAGATGGGTGAGGTGA | 85 | 2396 |
| 1104056 | N/A | N/A | 8201 | 8220 | TCTCCTAGCTTTTTCCCCAG | 131 | 2397 |
| 1104072 | N/A | N/A | 9327 | 9346 | CGTCACATTCACTAATATTT | 22 | 2398 |
| 1104088 | N/A | N/A | 9395 | 9414 | CCAATGCAAGTAAAAAGTAA | 92 | 2399 |
| 1104104 | N/A | N/A | 9434 | 9453 | AAGAGGAATTTTGTTCCTTA | 72 | 2400 |
| 1104120 | N/A | N/A | 9483 | 9502 | AGTCCTGAGACATGCATATC | 77 | 2401 |
| 1104136 | N/A | N/A | 9521 | 9540 | TACTAGTCAGCCTGGTTAGC | 69 | 2402 |
| 1104152 | N/A | N/A | 9550 | 9569 | GACTATCTAGGATTTGGCAG | 22 | 2403 |
| 1104168 | N/A | N/A | 9570 | 9589 | TCTGTGCTTTAGTGACCTGT | 56 | 2404 |
| 1104184 | N/A | N/A | 9637 | 9656 | TAGTGCTCAATACACATAGG | 58 | 2405 |

TABLE 32-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104200 | N/A | N/A | 9681 | 9700 | AGACAATTAACTAAAATAAA | 85 | 2406 |
| 1104216 | N/A | N/A | 10132 | 10151 | GACTCCGTCGAAAGCAGGCA | 63 | 2407 |
| 1104232 | N/A | N/A | 10570 | 10589 | CTGAAAACCCAGCACGGTAT | 142 | 2408 |
| 1104248 | N/A | N/A | 10695 | 10714 | CTCTTCCAAACGGGCTGGAG | 69 | 2409 |
| 1104264 | N/A | N/A | 10791 | 10810 | GCATGAGCCATCCTCTCCCA | 121 | 2410 |
| 1104280 | N/A | N/A | 11024 | 11043 | GTTGCTGGGAACCTTCTATG | 34 | 2411 |
| 1104296 | N/A | N/A | 11122 | 11141 | CAAGGCTCCCCTTAGAACAG | 56 | 2412 |
| 1104312 | N/A | N/A | 11162 | 11181 | AGAGAGTGTGTATTAGGATC | 37 | 2413 |
| 1104328 | N/A | N/A | 11243 | 11262 | AGAGTTGGAAGTGAAAGCTA | 73 | 2414 |
| 1104344 | N/A | N/A | 11370 | 11389 | AGATGAGCTCCCACTGTGGT | 74 | 2415 |
| 1104360 | N/A | N/A | 11432 | 11451 | GGTGAGATAACACTGGGAAA | 48 | 2416 |
| 1104376 | N/A | N/A | 11553 | 11572 | GTTCACACAGACCCCAGGTC | 96 | 2417 |

TABLE 33

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 5 | 517 |
| 1103161 | 222 | 241 | 3670 | 3689 | TGAGTGCCCCAGCCAGGGAG | 168 | 2418 |
| 1103177 | 443 | 462 | 3891 | 3910 | GGCGGTGAGTTGATCGAGCC | 101 | 2419 |
| 1103193 | 654 | 673 | 5243 | 5262 | TCTTCCTCAAGAACCGGATC | 68 | 2420 |
| 1103209 | 948 | 967 | 7305 | 7324 | CGCGCAGAGACTCCAGGTCG | 112 | 2421 |
| 1103225 | 1295 | 1314 | 10909 | 10928 | CCGCATCTCCACGGTCTTCA | 74 | 2422 |
| 1103241 | 1409 | 1428 | 11698 | 11717 | ACTATCCTGCTTCTGCTCGG | 41 | 2423 |
| 1103257 | 1578 | 1597 | 11867 | 11886 | TGAGTTTCTTGTTAGTTGGA | 24 | 2424 |
| 1103273 | 1702 | 1721 | 11991 | 12010 | ACAACAGGAATCAGGGATGT | 94 | 2425 |
| 1103289 | 1840 | 1859 | 12129 | 12148 | CTGGCCAGGGCTACCTTGTC | 95 | 2426 |
| 1103305 | 1879 | 1898 | 12168 | 12187 | ATATCCCACCTCATAAAAAC | 108 | 2427 |
| 1103321 | 2013 | 2032 | 12302 | 12321 | TCAGGGTCAGTCTAGGAGAA | 63 | 2428 |
| 1103337 | 2189 | 2208 | 12478 | 12497 | ATCCCCCAAGTGCTGAGAAT | 96 | 2429 |
| 1103353 | 2403 | 2422 | 12692 | 12711 | CACAATCCAGAGGCCAAGTG | 70 | 2430 |
| 1103369 | 2453 | 2472 | 12742 | 12761 | TTCTCTCCTGTTTCAGCATC | 32 | 2431 |
| 1103385 | 2497 | 2516 | 12786 | 12805 | GAAATGGGACAAAGTCATGC | 79 | 2432 |
| 1103401 | 2638 | 2657 | 12927 | 12946 | GGCTTAGGGAAAAGCAGCCG | 140 | 2433 |
| 1103417 | 2705 | 2724 | 12994 | 13013 | ATAGGGCACTACCTAGAATA | 117 | 2434 |

TABLE 33-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103433 | 2792 | 2811 | 13081 | 13100 | TGTCAGCCCTGAGCACCCGG | 64 | 2435 |
| 1103449 | 3031 | 3050 | 13320 | 13339 | AGCGACTAAAGGCAGCAGCA | 64 | 2436 |
| 1103465 | N/A | N/A | 8753 | 8772 | GTGATTTTCCCCGTCTTTGG | 26 | 2437 |
| 1103481 | N/A | N/A | 8892 | 8911 | ACTCCCTGTCAAGCTGGGCA | 110 | 2438 |
| 1103497 | N/A | N/A | 8991 | 9010 | CACTGCAGTTCCTGGGAAAA | 92 | 2439 |
| 1103513 | N/A | N/A | 9170 | 9189 | TCCAGGCACAGCGAGACCCA | 121 | 2440 |
| 1103529 | N/A | N/A | 9251 | 9270 | GGAAGAATCCTCTGAACTGA | 86 | 2441 |
| 1103545 | N/A | N/A | 9296 | 9315 | CAGGGAACATAAAACTTTAT | 135 | 2442 |
| 1103561 | N/A | N/A | 8409 | 8428 | CAGGACTCCAGTGCCCTTCC | 97 | 2443 |
| 1103577 | N/A | N/A | 8548 | 8567 | CCCACCTAGAAGTACCCTGG | 72 | 2444 |
| 1103593 | N/A | N/A | 8736 | 8755 | TGGTGCTTTTGCCCCCTGTA | 84 | 2445 |
| 1103609 | N/A | N/A | 4044 | 4063 | GGCCCCTCCCTGAGACTTCT | 161 | 2446 |
| 1103625 | N/A | N/A | 4218 | 4237 | CTGCACTGCTTTCCCCAGTA | 123 | 2447 |
| 1103641 | N/A | N/A | 4381 | 4400 | CTTTCCCTCACTTTCTTCAC | 135 | 2448 |
| 1103657 | N/A | N/A | 4479 | 4498 | GACCACCGCTTCACAGCTGT | 118 | 2449 |
| 1103673 | N/A | N/A | 4594 | 4613 | CATGTCCTCCTGCACTTGAA | 66 | 2450 |
| 1103689 | N/A | N/A | 4745 | 4764 | ACAGAGGACTTGTCTGGAGG | 77 | 2451 |
| 1103705 | N/A | N/A | 4963 | 4982 | CTCCCTGACCTGTCTATAGG | 97* | 2452 |
| 1103721 | N/A | N/A | 5171 | 5190 | CTTCATCTGCTTCCTGGAGT | 78* | 2453 |
| 1103737 | N/A | N/A | 5382 | 5401 | TACCTGCCAATCTCTGTTTC | 79 | 2454 |
| 1103753 | N/A | N/A | 5449 | 5468 | TCGAATGCTCTCTTGTCTCT | 92 | 2455 |
| 1103769 | N/A | N/A | 5543 | 5562 | GGTGAGAGAAGCGGTACCAG | 141 | 2456 |
| 1103785 | N/A | N/A | 5834 | 5853 | TGAAAGTCAGTCACCTGGAG | 102 | 2457 |
| 1103801 | N/A | N/A | 5908 | 5927 | GCAGTAATAATAATGGGTAC | 69 | 2458 |
| 1103817 | N/A | N/A | 5958 | 5977 | CAGGGCTTAGAACAGAACAG | 61 | 2459 |
| 1103833 | N/A | N/A | 6014 | 6033 | CTCTCATCTGTCAAAGAACA | 87 | 2460 |
| 1103849 | N/A | N/A | 6161 | 6180 | TGGTAGAGGCTCAGTAACCC | 60 | 2461 |
| 1103865 | N/A | N/A | 6246 | 6265 | TCTACGGGCACTATGTTTGG | 79 | 2462 |
| 1103881 | N/A | N/A | 6279 | 6298 | CACACTACATATAAGCTCTG | 188 | 2463 |
| 1103897 | N/A | N/A | 6398 | 6417 | TTTTCTGCCTCCAGGCTCTG | 93 | 2464 |
| 1103913 | N/A | N/A | 6469 | 6488 | CTTCTGCCACTCACACTCCT | 101 | 2465 |
| 1103929 | N/A | N/A | 6806 | 6825 | GTCAGTGGCACAATCCCGGG | 76 | 2466 |
| 1103945 | N/A | N/A | 6987 | 7006 | GCAAGCGAATGAATGAACAG | 76 | 2467 |
| 1103961 | N/A | N/A | 7123 | 7142 | ATCAGGGAGGTGAGCAGCAC | 51 | 2468 |
| 1103977 | N/A | N/A | 7360 | 7379 | GGTGGCCGTCCCTGCTCCGC | 89 | 2469 |
| 1103993 | N/A | N/A | 7760 | 7779 | TGATGAGGGCTCACCGGTTC | 77 | 2470 |
| 1104009 | N/A | N/A | 7896 | 7915 | GCTATGTGTGAGGCAGGCAC | 138 | 2471 |

TABLE 33-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104025 | N/A | N/A | 7979 | 7998 | ACCCAAGTCCTTGGCTTGA | 79 | 2472 |
| 1104041 | N/A | N/A | 8054 | 8073 | CAGAAGAGATGGGTGAGGTG | 71 | 2473 |
| 1104057 | N/A | N/A | 8202 | 8221 | ATCTCCTAGCTTTTTCCCCA | 147 | 2474 |
| 1104073 | N/A | N/A | 9345 | 9364 | AGAGAGAAAAATATAACACG | 90 | 2475 |
| 1104089 | N/A | N/A | 9401 | 9420 | TCAGGGCCAATGCAAGTAAA | 53 | 2476 |
| 1104105 | N/A | N/A | 9436 | 9455 | AGAAGAGGAATTTTGTTCCT | 68 | 2477 |
| 1104121 | N/A | N/A | 9484 | 9503 | AAGTCCTGAGACATGCATAT | 64 | 2478 |
| 1104137 | N/A | N/A | 9522 | 9541 | CTACTAGTCAGCCTGGTTAG | 68 | 2479 |
| 1104153 | N/A | N/A | 9551 | 9570 | TGACTATCTAGGATTTGGCA | 38 | 2480 |
| 1104169 | N/A | N/A | 9571 | 9590 | ATCTGTGCTTTAGTGACCTG | 80 | 2481 |
| 1104185 | N/A | N/A | 9638 | 9657 | TTAGTGCTCAATACACATAG | 75 | 2482 |
| 1104201 | N/A | N/A | 9682 | 9701 | GAGACAATTAACTAAAATAA | 86 | 2483 |
| 1104217 | N/A | N/A | 10133 | 10152 | AGACTCCGTCGAAAGCAGGC | 78 | 2484 |
| 1104233 | N/A | N/A | 10571 | 10590 | TCTGAAAACCCAGCACGGTA | 116 | 2485 |
| 1104249 | N/A | N/A | 10696 | 10715 | GCTCTTCCAAACGGGCTGGA | 116 | 2486 |
| 1104265 | N/A | N/A | 10795 | 10814 | CAGGGCATGAGCCATCCTCT | 101 | 2487 |
| 1104281 | N/A | N/A | 11056 | 11075 | CTCCTCCAGAATTCCCTGGG | 140 | 2488 |
| 1104297 | N/A | N/A | 11130 | 11149 | TTTGGTACCAAGGCTCCCCT | 72 | 2489 |
| 1104313 | N/A | N/A | 11178 | 11197 | TTTGAGGGTGAGAAAGAGAG | 82 | 2490 |
| 1104329 | N/A | N/A | 11259 | 11278 | CCCAACTGTGTCTGCTAGAG | 47 | 2491 |
| 1104345 | N/A | N/A | 11371 | 11390 | AAGATGAGCTCCCACTGTGG | 111 | 2492 |
| 1104361 | N/A | N/A | 11434 | 11453 | GTGGTGAGATAACACTGGGA | 43 | 2493 |
| 1104377 | N/A | N/A | 11557 | 11576 | AGGAGTTCACACAGACCCCA | 92 | 2494 |

TABLE 34

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 6 | 517 |
| 1103162 | 224 | 243 | 3672 | 3691 | ATTGAGTGCCCCAGCCAGGG | 94 | 2495 |
| 1103178 | 468 | 487 | 3916 | 3935 | TCTCAACCTCCAGCCGGGCG | 23* | 2496 |
| 1103194 | 687 | 706 | 5573 | 5592 | GCTCCTGGAGTTCCCGAACC | 139 | 2497 |
| 1103210 | 949 | 968 | 7306 | 7325 | CCGCGCAGAGACTCCAGGTC | 98 | 2498 |
| 1103226 | 1316 | 1335 | N/A | N/A | CTCCTTAATGACCTCTCCAT | 95 | 2499 |
| 1103242 | 1419 | 1438 | 11708 | 11727 | AGGCGGAGCAACTATCCTGC | 150 | 2500 |

TABLE 34-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103258 | 1579 | 1598 | 11868 | 11887 | GTGAGTTTCTTGTTAGTTGG | 35 | 2501 |
| 1103274 | 1706 | 1725 | 11995 | 12014 | CATAACAACAGGAATCAGGG | 49 | 2502 |
| 1103290 | 1846 | 1865 | 12135 | 12154 | AAGCCTCTGGCCAGGGCTAC | 113 | 2503 |
| 1103306 | 1880 | 1899 | 12169 | 12188 | GATATCCCACCTCATAAAAA | 98 | 2504 |
| 1103322 | 2015 | 2034 | 12304 | 12323 | GATCAGGGTCAGTCTAGGAG | 46 | 2505 |
| 1103338 | 2196 | 2215 | 12485 | 12504 | ACAACAGATCCCCCAAGTGC | 89 | 2506 |
| 1103354 | 2405 | 2424 | 12694 | 12713 | CCCACAATCCAGAGGCCAAG | 79 | 2507 |
| 1103370 | 2454 | 2473 | 12743 | 12762 | TTTCTCTCCTGTTTCAGCAT | 31 | 2508 |
| 1103386 | 2498 | 2517 | 12787 | 12806 | AGAAATGGGACAAAGTCATG | 102 | 2509 |
| 1103402 | 2643 | 2662 | 12932 | 12951 | CCCTTGGCTTAGGGAAAAGC | 102 | 2510 |
| 1103418 | 2706 | 2725 | 12995 | 13014 | AATAGGGCACTACCTAGAAT | 130 | 2511 |
| 1103434 | 2793 | 2812 | 13082 | 13101 | GTGTCAGCCCTGAGCACCCG | 73 | 2512 |
| 1103450 | 3032 | 3051 | 13321 | 13340 | CAGCGACTAAAGGCAGCAGC | 76 | 2513 |
| 1103466 | N/A | N/A | 8759 | 8778 | GACCTTGTGATTTTCCCCGT | 55 | 2514 |
| 1103482 | N/A | N/A | 8893 | 8912 | CACTCCCTGTCAAGCTGGGC | 112 | 2515 |
| 1103498 | N/A | N/A | 9028 | 9047 | TAATGTACAGTTACTCTGTA | 80 | 2516 |
| 1103514 | N/A | N/A | 9206 | 9225 | CCTCAGGGATGAAAGAATAA | 56 | 2517 |
| 1103530 | N/A | N/A | 9252 | 9271 | GGGAAGAATCCTCTGAACTG | 83 | 2518 |
| 1103546 | N/A | N/A | 9297 | 9316 | GCAGGGAACATAAAACTTTA | 132 | 2519 |
| 1103562 | N/A | N/A | 8441 | 8460 | CTGGAGCAACCTACAGGCCC | 103 | 2520 |
| 1103578 | N/A | N/A | 8550 | 8569 | GCCCCACCTAGAAGTACCCT | 83 | 2521 |
| 1103594 | N/A | N/A | 8738 | 8757 | TTTGGTGCTTTTGCCCCCTG | 76 | 2522 |
| 1103610 | N/A | N/A | 4045 | 4064 | CGGCCCCTCCCTGAGACTTC | 92 | 2523 |
| 1103626 | N/A | N/A | 4219 | 4238 | CCTGCACTGCTTTCCCCAGT | 124 | 2524 |
| 1103642 | N/A | N/A | 4384 | 4403 | GCTCTTTCCCTCACTTTCTT | 111 | 2525 |
| 1103658 | N/A | N/A | 4480 | 4499 | TGACCACCGCTTCACAGCTG | 66 | 2526 |
| 1103674 | N/A | N/A | 4598 | 4617 | CGCACATGTCCTCCTGCACT | 122 | 2527 |
| 1103690 | N/A | N/A | 4746 | 4765 | GACAGAGGACTTGTCTGGAG | 69 | 2528 |
| 1103706 | N/A | N/A | 4966 | 4985 | CACCTCCCTGACCTGTCTAT | 165* | 2529 |
| 1103722 | N/A | N/A | 5173 | 5192 | GGCTTCATCTGCTTCCTGGA | 11* | 2530 |
| 1103738 | N/A | N/A | 5390 | 5409 | CCTGTCTCTACCTGCCAATC | 93 | 2531 |
| 1103754 | N/A | N/A | 5456 | 5475 | CAGGAGTTCGAATGCTCTCT | 77 | 2532 |
| 1103770 | N/A | N/A | 5555 | 5574 | CCTCCTGACCAGGGTGAGAG | 91 | 2533 |
| 1103786 | N/A | N/A | 5838 | 5857 | CTGGTGAAAGTCAGTCACCT | 84 | 2534 |
| 1103802 | N/A | N/A | 5909 | 5928 | AGCAGTAATAATAATGGGTA | 122 | 2535 |
| 1103818 | N/A | N/A | 5960 | 5979 | CACAGGGCTTAGAACAGAAC | 101 | 2536 |
| 1103834 | N/A | N/A | 6015 | 6034 | TCTCTCATCTGTCAAAGAAC | 81 | 2537 |

TABLE 34-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103850 | N/A | N/A | 6162 | 6181 | ATGGTAGAGGCTCAGTAACC | 66 | 2538 |
| 1103866 | N/A | N/A | 6247 | 6266 | CTCTACGGGCACTATGTTTG | 72 | 2539 |
| 1103882 | N/A | N/A | 6286 | 6305 | TGGCTCCCACACTACATATA | 89 | 2540 |
| 1103898 | N/A | N/A | 6401 | 6420 | TGCTTTTCTGCCTCCAGGCT | 82 | 2541 |
| 1103914 | N/A | N/A | 6476 | 6495 | CCAGTGGCTTCTGCCACTCA | 92 | 2542 |
| 1103930 | N/A | N/A | 6898 | 6917 | AGCGGAGGCCTGGGTGTTTT | 74 | 2543 |
| 1103946 | N/A | N/A | 6988 | 7007 | AGCAAGCGAATGAATGAACA | 116 | 2544 |
| 1103962 | N/A | N/A | 7124 | 7143 | AATCAGGGAGGTGAGCAGCA | 71 | 2545 |
| 1103978 | N/A | N/A | 7384 | 7403 | CCCTTCTCCCCTGGCATCTC | 130 | 2546 |
| 1103994 | N/A | N/A | 7792 | 7811 | GTGAGGCAGCAGGGAGACTT | 80 | 2547 |
| 1104010 | N/A | N/A | 7904 | 7923 | GACTGCCTGCTATGTGTGAG | 118 | 2548 |
| 1104026 | N/A | N/A | 7981 | 8000 | TGACCCAAGTCCTTGGCCTT | 109 | 2549 |
| 1104042 | N/A | N/A | 8056 | 8075 | GGCAGAAGAGATGGGTGAGG | 75 | 2550 |
| 1104058 | N/A | N/A | 8207 | 8226 | ACTCCATCTCCTAGCTTTTT | 95 | 2551 |
| 1104074 | N/A | N/A | 9347 | 9366 | CGAGAGAGAAAAATATAACA | 129 | 2552 |
| 1104090 | N/A | N/A | 9403 | 9422 | TTTCAGGGCCAATGCAAGTA | 49 | 2553 |
| 1104106 | N/A | N/A | 9447 | 9466 | TCTAGTCCAGAAGAAGAGGA | 76 | 2554 |
| 1104122 | N/A | N/A | 9494 | 9513 | ATGCTGAATTAAGTCCTGAG | 38 | 2555 |
| 1104138 | N/A | N/A | 9523 | 9542 | TCTACTAGTCAGCCTGGTTA | 68 | 2556 |
| 1104154 | N/A | N/A | 9553 | 9572 | TGTGACTATCTAGGATTTGG | 68 | 2557 |
| 1104170 | N/A | N/A | 9572 | 9591 | TATCTGTGCTTTAGTGACCT | 53 | 2558 |
| 1104186 | N/A | N/A | 9639 | 9658 | ATTAGTGCTCAATACACATA | 101 | 2559 |
| 1104202 | N/A | N/A | 9683 | 9702 | GGAGACAATTAACTAAAATA | 94 | 2560 |
| 1104218 | N/A | N/A | 10135 | 10154 | TAAGACTCCGTCGAAAGCAG | 131 | 2561 |
| 1104234 | N/A | N/A | 10572 | 10591 | TTCTGAAAACCCAGCACGGT | 110 | 2562 |
| 1104250 | N/A | N/A | 10708 | 10727 | GAGAGAGCCTAGGCTCTTCC | 70 | 2563 |
| 1104266 | N/A | N/A | 10796 | 10815 | TCAGGGCATGAGCCATCCTC | 60 | 2564 |
| 1104282 | N/A | N/A | 11065 | 11084 | TTCCTTGCTCTCCTCCAGAA | 156 | 2565 |
| 1104298 | N/A | N/A | 11144 | 11163 | TCCCATCTAGTGGCTTTGGT | 48 | 2566 |
| 1104314 | N/A | N/A | 11212 | 11231 | TCTCTTTCTCTCCCTGGCAA | 74 | 2567 |
| 1104330 | N/A | N/A | 11264 | 11283 | CCATCCCCAACTGTGTCTGC | 64 | 2568 |
| 1104346 | N/A | N/A | 11381 | 11400 | CTGCTGGAGTAAGATGAGCT | 99 | 2569 |
| 1104362 | N/A | N/A | 11478 | 11497 | TTCTTGATAGTAACCACAGC | 53 | 2570 |
| 1104378 | N/A | N/A | 11558 | 11577 | TAGGAGTTCACACAGACCCC | 164 | 2571 |

TABLE 35

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 8 | 517 |
| 1103163 | 233 | 252 | 3681 | 3700 | GAAGCCAGCATTGAGTGCCC | 109 | 2572 |
| 1103179 | 484 | 503 | 3932 | 3951 | TGTGCCAGATTGTCCCTCTC | 13* | 2573 |
| 1103195 | 713 | 732 | 5599 | 5618 | CACATGGACCTGCTGTCGGG | 107 | 2574 |
| 1103211 | 951 | 970 | 7308 | 7327 | TGCCGCGCAGAGACTCCAGG | 90 | 2575 |
| 1103227 | 1317 | 1336 | N/A | N/A | ACTCCTTAATGACCTCTCCA | 151 | 2576 |
| 1103243 | 1434 | 1453 | 11723 | 11742 | GAAATGTGCCAGCAGAGGCG | 96 | 2577 |
| 1103259 | 1581 | 1600 | 11870 | 11889 | GGGTGAGTTTCTTGTTAGTT | 15 | 2578 |
| 1103275 | 1712 | 1731 | 12001 | 12020 | AGTTTCCATAACAACAGGAA | 91 | 2579 |
| 1103291 | 1851 | 1870 | 12140 | 12159 | AAAACAAGCCTCTGGCCAGG | 115 | 2580 |
| 1103307 | 1881 | 1900 | 12170 | 12189 | GGATATCCCACCTCATAAAA | 107 | 2581 |
| 1103323 | 2030 | 2049 | 12319 | 12338 | CACCCATCTTAGACTGATCA | 116 | 2582 |
| 1103339 | 2197 | 2216 | 12486 | 12505 | CACAACAGATCCCCCAAGTG | 110 | 2583 |
| 1103355 | 2409 | 2428 | 12698 | 12717 | AATTCCCACAATCCAGAGGC | 72 | 2584 |
| 1103371 | 2455 | 2474 | 12744 | 12763 | CTTTCTCTCCTGTTTCAGCA | 20 | 2585 |
| 1103387 | 2506 | 2525 | 12795 | 12814 | AGGCCTTTAGAAATGGGACA | 76 | 2586 |
| 1103403 | 2656 | 2675 | 12945 | 12964 | GGACCGCAAGAGGCCCTTGG | 83 | 2587 |
| 1103419 | 2707 | 2726 | 12996 | 13015 | AAATAGGGCACTACCTAGAA | 100 | 2588 |
| 1103435 | 2831 | 2850 | 13120 | 13139 | CTGCTCAGTCAAAGCAGAGT | 99 | 2589 |
| 1103467 | N/A | N/A | 8765 | 8784 | TCTTGTGACCTTGTGATTTT | 55 | 2590 |
| 1103483 | N/A | N/A | 8894 | 8913 | TCACTCCCTGTCAAGCTGGG | 130 | 2591 |
| 1103499 | N/A | N/A | 9029 | 9048 | TTAATGTACAGTTACTCTGT | 98 | 2592 |
| 1103515 | N/A | N/A | 9214 | 9233 | CGATGGAGCCTCAGGGATGA | 57 | 2593 |
| 1103531 | N/A | N/A | 9253 | 9272 | AGGGAAGAATCCTCTGAACT | 59 | 2594 |
| 1103547 | N/A | N/A | 9298 | 9317 | AGCAGGGAACATAAAACTTT | 79 | 2595 |
| 1103563 | N/A | N/A | 8458 | 8477 | TGATCCTCAGTCCCAGTCTG | 95 | 2596 |
| 1103579 | N/A | N/A | 8552 | 8571 | AAGCCCCACCTAGAAGTACC | 131 | 2597 |
| 1103595 | N/A | N/A | 3965 | 3984 | CCTCCTCACTTCTGCCTCAC | 77* | 2598 |
| 1103611 | N/A | N/A | 4046 | 4065 | TCGGCCCCTCCCTGAGACTT | 74 | 2599 |
| 1103627 | N/A | N/A | 4220 | 4239 | TCCTGCACTGCTTTCCCCAG | 80 | 2600 |
| 1103643 | N/A | N/A | 4385 | 4404 | TGCTCTTTCCCTCACTTTCT | 119 | 2601 |
| 1103659 | N/A | N/A | 4484 | 4503 | ATTATGACCACCGCTTCACA | 54 | 2602 |
| 1103675 | N/A | N/A | 4603 | 4622 | ACACACGCACATGTCCTCCT | 157 | 2603 |
| 1103691 | N/A | N/A | 4751 | 4770 | CCTTAGACAGAGGACTTGTC | 90 | 2604 |
| 1103707 | N/A | N/A | 4967 | 4986 | CCACCTCCCTGACCTGTCTA | 102* | 2605 |
| 1103723 | N/A | N/A | 5301 | 5320 | AGTTGCAATCTCTGTGTTGA | 105 | 2606 |
| 1103739 | N/A | N/A | 5391 | 5410 | TCCTGTCTCTACCTGCCAAT | 81 | 2607 |

TABLE 35-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103755 | N/A | N/A | 5457 | 5476 | CCAGGAGTTCGAATGCTCTC | 97 | 2608 |
| 1103771 | N/A | N/A | 5557 | 5576 | AACCTCCTGACCAGGGTGAG | 87 | 2609 |
| 1103787 | N/A | N/A | 5839 | 5858 | TCTGGTGAAAGTCAGTCACC | 99 | 2610 |
| 1103803 | N/A | N/A | 5910 | 5929 | TAGCAGTAATAATAATGGGT | 53 | 2611 |
| 1103819 | N/A | N/A | 5967 | 5986 | TGAAAAGCACAGGGCTTAGA | 118 | 2612 |
| 1103835 | N/A | N/A | 6016 | 6035 | CTCTCTCATCTGTCAAAGAA | 64 | 2613 |
| 1103851 | N/A | N/A | 6164 | 6183 | ATATGGTAGAGGCTCAGTAA | 70 | 2614 |
| 1103867 | N/A | N/A | 6253 | 6272 | GGTGTTCTCTACGGGCACTA | 87 | 2615 |
| 1103883 | N/A | N/A | 6289 | 6308 | TCCTGGCTCCCACACTACAT | 109 | 2616 |
| 1103899 | N/A | N/A | 6402 | 6421 | GTGCTTTTCTGCCTCCAGGC | 32 | 2617 |
| 1103915 | N/A | N/A | 6489 | 6508 | CCCTGCTCAGACACCAGTGG | 157 | 2618 |
| 1103931 | N/A | N/A | 6899 | 6918 | GAGCGGAGGCCTGGGTGTTT | 123 | 2619 |
| 1103947 | N/A | N/A | 7005 | 7024 | TAGCACAACACCTGGTCAGC | 92 | 2620 |
| 1103963 | N/A | N/A | 7127 | 7146 | GGAAATCAGGGAGGTGAGCA | 58 | 2621 |
| 1103979 | N/A | N/A | 7385 | 7404 | GCCCTTCTCCCCTGGCATCT | 83 | 2622 |
| 1103995 | N/A | N/A | 7799 | 7818 | CTCTACCGTGAGGCAGCAGG | 97 | 2623 |
| 1104011 | N/A | N/A | 7909 | 7928 | CTAGTGACTGCCTGCTATGT | 112 | 2624 |
| 1104027 | N/A | N/A | 8007 | 8026 | GGGAGTATGCCTCTTAGTTT | 55 | 2625 |
| 1104043 | N/A | N/A | 8071 | 8090 | AGAAAGTTOCAAGGAGGCAG | 112 | 2626 |
| 1104059 | N/A | N/A | 8208 | 8227 | AACTCCATCTCCTAGCTTTT | 85 | 2627 |
| 1104075 | N/A | N/A | 9348 | 9367 | CCGAGAGAGAAAAATATAAC | 66 | 2628 |
| 1104091 | N/A | N/A | 9404 | 9423 | ATTTCAGGGCCAATGCAAGT | 85 | 2629 |
| 1104107 | N/A | N/A | 9448 | 9467 | TTCTAGTCCAGAAGAAGAGG | 72 | 2630 |
| 1104123 | N/A | N/A | 9495 | 9514 | GATGCTGAATTAAGTCCTGA | 41 | 2631 |
| 1104139 | N/A | N/A | 9527 | 9546 | TACCTCTACTAGTCAGCCTG | 78 | 2632 |
| 1104155 | N/A | N/A | 9554 | 9573 | CTGTGACTATCTAGGATTTG | 70 | 2633 |
| 1104171 | N/A | N/A | 9573 | 9592 | TTATCTGTGCTTTAGTGACC | 54 | 2634 |
| 1104187 | N/A | N/A | 9642 | 9661 | CATATTAGTGCTCAATACAC | 59 | 2635 |
| 1104203 | N/A | N/A | 9703 | 9722 | ACTTCTCTAGGTGGGAGAGA | 58 | 2636 |
| 1104219 | N/A | N/A | 10136 | 10155 | GTAAGACTCCGTCGAAAGCA | 99 | 2637 |
| 1104235 | N/A | N/A | 10573 | 10592 | TTTCTGAAAACCCAGCACGG | 132 | 2638 |
| 1104251 | N/A | N/A | 10730 | 10749 | TGAGAACCTATGCAACCGAG | 62 | 2639 |
| 1104267 | N/A | N/A | 10798 | 10817 | TTTCAGGGCATGAGCCATCC | 140 | 2640 |
| 1104283 | N/A | N/A | 11070 | 11089 | TCAGTTTCCTTGCTCTCCTC | 82 | 2641 |
| 1104299 | N/A | N/A | 11146 | 11165 | GATCCCATCTAGTGGCTTTG | 39 | 2642 |
| 1104315 | N/A | N/A | 11213 | 11232 | TTCTCTTTCTCTCCCTGGCA | 85 | 2643 |

TABLE 35-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104331 | N/A | N/A | 11265 | 11284 | CCCATCCCCAACTGTGTCTG | 73 | 2644 |
| 1104347 | N/A | N/A | 11384 | 11403 | AAGCTGCTGGAGTAAGATGA | 122 | 2645 |
| 1104363 | N/A | N/A | 11483 | 11502 | TACTTTTCTTGATAGTAACC | 74 | 2646 |
| 1104379 | N/A | N/A | 11559 | 11578 | TTAGGAGTTCACACAGACCC | 85 | 2647 |

TABLE 36

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 13336 | 13355 | GTCTTTATTTTTCCTCAGCG | 10 | 517 |
| 1103164 | 254 | 273 | 3702 | 3721 | CTCACTGGCCCGGGTCTCCT | 133 | 2648 |
| 1103180 | 485 | 504 | 3933 | 3952 | CTGTGCCAGATTGTCCCTCT | 16* | 2649 |
| 1103196 | 714 | 733 | 5600 | 5619 | CCACATGGACCTGCTGTCGG | 121 | 2650 |
| 1103212 | 1046 | 1065 | 7618 | 7637 | TTCCTCCAGCCGCGCCAGCG | 135 | 2651 |
| 1103228 | 1324 | 1343 | 11613 | 11632 | TGCTTGGACTCCTTAATGAC | 97 | 2652 |
| 1103244 | 1436 | 1455 | 11725 | 11744 | GGGAAATGTGCCAGCAGAGG | 39 | 2653 |
| 1103260 | 1601 | 1620 | 11890 | 11909 | CCCTCCAGACTGCCCCTTGG | 95 | 2654 |
| 1103276 | 1726 | 1745 | 12015 | 12034 | CCATCTCTGGCAACAGTTTC | 71 | 2655 |
| 1103292 | 1856 | 1875 | 12145 | 12164 | AAGACAAAACAAGCCTCTGG | 88 | 2656 |
| 1103308 | 1882 | 1901 | 12171 | 12190 | GGGATATCCCACCTCATAAA | 88 | 2657 |
| 1103324 | 2031 | 2050 | 12320 | 12339 | CCACCCATCTTAGACTGATC | 100 | 2658 |
| 1103340 | 2198 | 2217 | 12487 | 12506 | ACACAACAGATCCCCCAAGT | 90 | 2659 |
| 1103356 | 2410 | 2429 | 12699 | 12718 | TAATTCCCACAATCCAGAGG | 115 | 2660 |
| 1103372 | 2459 | 2478 | 12748 | 12767 | TCCCCTTTCTCTCCTGTTTC | 101 | 2661 |
| 1103388 | 2508 | 2527 | 12797 | 12816 | AGAGGCCTTTAGAAATGGGA | 102 | 2662 |
| 1103404 | 2662 | 2681 | 12951 | 12970 | AAGAAGGGACCGCAAGAGGC | 83 | 2663 |
| 1103420 | 2715 | 2734 | 13004 | 13023 | CAATTGTAAAATAGGGCACT | 115 | 2664 |
| 1103436 | 2835 | 2854 | 13124 | 13143 | CAGTCTGCTCAGTCAAAGCA | 121 | 2665 |
| 1103468 | N/A | N/A | 8766 | 8785 | ATCTTGTGACCTTGTGATTT | 75 | 2666 |
| 1103484 | N/A | N/A | 8895 | 8914 | CTCACTCCCTGTCAAGCTGG | 98 | 2667 |
| 1103500 | N/A | N/A | 9033 | 9052 | CAGTTTAATGTACAGTTACT | 90 | 2668 |
| 1103516 | N/A | N/A | 9215 | 9234 | GCGATGGAGCCTCAGGGATG | 28 | 2669 |
| 1103532 | N/A | N/A | 9254 | 9273 | GAGGGAAGAATCCTCTGAAC | 86 | 2670 |
| 1103548 | N/A | N/A | 9305 | 9324 | CATTAAGAGCAGGGAACATA | 85 | 2671 |
| 1103564 | N/A | N/A | 8492 | 8511 | GAAGGCCCCCAGGGAGAGCT | 72 | 2672 |
| 1103580 | N/A | N/A | 8553 | 8572 | CAAGCCCCACCTAGAAGTAC | 107 | 2673 |

TABLE 36-continued

| Reduction of GFAP RNA by 5-10-5 MOE gapmers with mixed PO/PS internucleoside linkages in U251 cells | | | | | | | |
|---|---|---|---|---|---|---|---|
| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
| 1103596 | N/A | N/A | 3966 | 3985 | CCCTCCTCACTTCTGCCTCA | 98* | 2674 |
| 1103612 | N/A | N/A | 4047 | 4066 | TTCGGCCCCTCCCTGAGACT | 77 | 2675 |
| 1103628 | N/A | N/A | 4227 | 4246 | CCGCTGCTCCTGCACTGCTT | 123 | 2676 |
| 1103644 | N/A | N/A | 4387 | 4406 | CCTGCTCTTTCCCTCACTTT | 110 | 2677 |
| 1103660 | N/A | N/A | 4485 | 4504 | TATTATGACCACCGCTTCAC | 85 | 2678 |
| 1103676 | N/A | N/A | 4604 | 4623 | CACACACGCACATGTCCTCC | 106 | 2679 |
| 1103692 | N/A | N/A | 4754 | 4773 | GGGCCTTAGACAGAGGACTT | 97 | 2680 |
| 1103708 | N/A | N/A | 4970 | 4989 | CCTCCACCTCCCTGACCTGT | 91* | 2681 |
| 1103724 | N/A | N/A | 5302 | 5321 | CAGTTGCAATCTCTGTGTTG | 127 | 2682 |
| 1103740 | N/A | N/A | 5392 | 5411 | TTCCTGTCTCTACCTGCCAA | 153 | 2683 |
| 1103756 | N/A | N/A | 5475 | 5494 | CTTCTGCCTGCCCCTCGGCC | 109 | 2684 |
| 1103772 | N/A | N/A | 5558 | 5577 | GAACCTCCTGACCAGGGTGA | 116 | 2685 |
| 1103788 | N/A | N/A | 5840 | 5859 | CTCTGGTGAAAGTCAGTCAC | 112 | 2686 |
| 1103804 | N/A | N/A | 5911 | 5930 | GTAGCAGTAATAATAATGGG | 93 | 2687 |
| 1103820 | N/A | N/A | 5969 | 5988 | CATGAAAAGCACAGGGCTTA | 94 | 2688 |
| 1103836 | N/A | N/A | 6017 | 6036 | GCTCTCTCATCTGTCAAAGA | 59 | 2689 |
| 1103852 | N/A | N/A | 6197 | 6216 | AGACACCTCTCTGTGTCCTG | 60 | 2690 |
| 1103868 | N/A | N/A | 6255 | 6274 | GTGGTGTTCTCTACGGGCAC | 95 | 2691 |
| 1103884 | N/A | N/A | 6308 | 6327 | GCCCCCTCTACAGTGTCTTT | 85 | 2692 |
| 1103900 | N/A | N/A | 6405 | 6424 | TCTGTGCTTTTCTGCCTCCA | 59 | 2693 |
| 1103916 | N/A | N/A | 6493 | 6512 | CTCACCCTGCTCAGACACCA | 105 | 2694 |
| 1103932 | N/A | N/A | 6900 | 6919 | CGAGCGGAGGCCTGGGTGTT | 59 | 2695 |
| 1103948 | N/A | N/A | 7006 | 7025 | CTAGCACAACACCTGGTCAG | 106 | 2696 |
| 1103964 | N/A | N/A | 7195 | 7214 | AGGTCTGCAAACTAGGTGGG | 93 | 2697 |
| 1103980 | N/A | N/A | 7414 | 7433 | CCCGCCCTCGACCCAGGTCC | 121 | 2698 |
| 1103996 | N/A | N/A | 7802 | 7821 | GAGCTCTACCGTGAGGCAGC | 101 | 2699 |
| 1104012 | N/A | N/A | 7911 | 7930 | ATCTAGTGACTGCCTGCTAT | 95 | 2700 |
| 1104028 | N/A | N/A | 8031 | 8050 | AGTCCAATCTTGGCTGGGAA | 80 | 2701 |
| 1104044 | N/A | N/A | 8073 | 8092 | GAAGAAAGTTCCAAGGAGGC | 94 | 2702 |
| 1104060 | N/A | N/A | 8209 | 8228 | TAACTCCATCTCCTAGCTTT | 89 | 2703 |
| 1104076 | N/A | N/A | 9349 | 9368 | CCCGAGAGAGAAAAATATAA | 99 | 2704 |
| 1104092 | N/A | N/A | 9406 | 9425 | TCATTTCAGGGCCAATGCAA | 63 | 2705 |
| 1104108 | N/A | N/A | 9450 | 9469 | TATTCTAGTCCAGAAGAAGA | 127 | 2706 |
| 1104124 | N/A | N/A | 9504 | 9523 | AGCCTTTCTGATGCTGAATT | 52 | 2707 |
| 1104140 | N/A | N/A | 9528 | 9547 | TTACCTCTACTAGTCAGCCT | 75 | 2708 |
| 1104156 | N/A | N/A | 9555 | 9574 | CCTGTGACTATCTAGGATTT | 52 | 2709 |

TABLE 36-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104172 | N/A | N/A | 9574 | 9593 | TTTATCTGTGCTTTAGTGAC | 50 | 2710 |
| 1104188 | N/A | N/A | 9651 | 9670 | CATGTGGCACATATTAGTGC | 97 | 2711 |
| 1104204 | N/A | N/A | 9704 | 9723 | TACTTCTCTAGGTGGGAGAG | 83 | 2712 |
| 1104220 | N/A | N/A | 10137 | 10156 | AGTAAGACTCCGTCGAAAGC | 124 | 2713 |
| 1104236 | N/A | N/A | 10574 | 10593 | CTTTCTGAAAACCCAGCACG | 87 | 2714 |
| 1104252 | N/A | N/A | 10731 | 10750 | ATGAGAACCTATGCAACCGA | 68 | 2715 |
| 1104268 | N/A | N/A | 10807 | 10826 | CTCATGGACTTTCAGGGCAT | 84 | 2716 |
| 1104284 | N/A | N/A | 11076 | 11095 | TTACATTCAGTTTCCTTGCT | 108 | 2717 |
| 1104300 | N/A | N/A | 11147 | 11166 | GGATCCCATCTAGTGGCTTT | 94 | 2718 |
| 1104316 | N/A | N/A | 11222 | 11241 | TAACTTTAATTCTCTTTCTC | 135 | 2719 |
| 1104332 | N/A | N/A | 11266 | 11285 | CCCCATCCCCAACTGTGTCT | 80 | 2720 |
| 1104348 | N/A | N/A | 11385 | 11404 | TAAGCTGCTGGAGTAAGATG | 92 | 2721 |
| 1104364 | N/A | N/A | 11484 | 11503 | TTACTTTTCTTGATAGTAAC | 89 | 2722 |
| 1104380 | N/A | N/A | 11573 | 11592 | GCACAGTGCAACAGTTAGGA | 38 | 2723 |

TABLE 37

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1047582 | 3047 | 3066 | 3336 | 13355 | GTCTTTATTTTTCCTCAGCG | 6 | 517 |
| 1103165 | 261 | 280 | 3709 | 3728 | CTGCCCGCTCACTGGCCCGG | 98 | 2724 |
| 1103181 | 505 | 524 | 3953 | 3972 | TGCCTCACAGTGGCCAGGTC | 45* | 2725 |
| 1103197 | 756 | 775 | 5642 | 5661 | CTTTCAGGGCTGCGGTGAGG | 99 | 2726 |
| 1103213 | 1048 | 1067 | 7620 | 7639 | TCTTCCTCCAGCCGCGCCAG | 53 | 2727 |
| 1103229 | 1325 | 1344 | 11614 | 11633 | CTGCTTGGACTCCTTAATGA | 73 | 2728 |
| 1103245 | 1497 | 1516 | 11786 | 11805 | AAGCTGACCTAGGGACAGAG | 106 | 2729 |
| 1103261 | 1602 | 1621 | 11891 | 11910 | CCCCTCCAGACTGCCCCTTG | 73 | 2730 |
| 1103277 | 1727 | 1746 | 12016 | 12035 | TCCATCTCTGGCAACAGTTT | 48 | 2731 |
| 1103293 | 1857 | 1876 | 12146 | 12165 | AAAGACAAAACAAGCCTCTG | 71 | 2732 |
| 1103309 | 1883 | 1902 | 12172 | 12191 | AGGGATATCCCACCTCATAA | 159 | 2733 |
| 1103325 | 2057 | 2076 | 12346 | 12365 | TGACTGCCCCAGGTGGCAGG | 116 | 2734 |
| 1103341 | 2199 | 2218 | 12488 | 12507 | TACACAACAGATCCCCCAAG | 86 | 2735 |
| 1103357 | 2411 | 2430 | 12700 | 12719 | TTAATTCCCACAATCCAGAG | 104 | 2736 |
| 1103373 | 2460 | 2479 | 12749 | 12768 | ATCCCCTTTCTCTCCTGTTT | 76 | 2737 |
| 1103389 | 2509 | 2528 | 12798 | 12817 | AAGAGGCCTTTAGAAATGGG | 71 | 2738 |
| 1103405 | 2663 | 2682 | 12952 | 12971 | TAAGAAGGGACCGCAAGAGG | 81 | 2739 |

TABLE 37-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1103421 | 2716 | 2735 | 13005 | 13024 | ACAATTGTAAAATAGGGCAC | 81 | 2740 |
| 1103437 | 2837 | 2856 | 13126 | 13145 | ACCAGTCTGCTCAGTCAAAG | 90 | 2741 |
| 1103469 | N/A | N/A | 8767 | 8786 | TATCTTGTGACCTTGTGATT | 54 | 2742 |
| 1103485 | N/A | N/A | 8896 | 8915 | GCTCACTCCCTGTCAAGCTG | 76 | 2743 |
| 1103501 | N/A | N/A | 9042 | 9061 | AAGCTCTGCCAGTTTAATGT | 57 | 2744 |
| 1103517 | N/A | N/A | 9216 | 9235 | AGCGATGGAGCCTCAGGGAT | 83 | 2745 |
| 1103533 | N/A | N/A | 9255 | 9274 | TGAGGGAAGAATCCTCTGAA | 92 | 2746 |
| 1103549 | N/A | N/A | 9306 | 9325 | ACATTAAGAGCAGGGAACAT | 105 | 2747 |
| 1103565 | N/A | N/A | 8499 | 8518 | GTGTCACGAAGGCCCCCAGG | 72 | 2748 |
| 1103581 | N/A | N/A | 8556 | 8575 | CTGCAAGCCCCACCTAGAAG | 94 | 2749 |
| 1103597 | N/A | N/A | 3989 | 4008 | TCACAAGGCCCCCCTTCCCC | 98 | 2750 |
| 1103613 | N/A | N/A | 4048 | 4067 | GTTCGGCCCCTCCCTGAGAC | 90 | 2751 |
| 1103629 | N/A | N/A | 4228 | 4247 | CCCGCTGCTCCTGCACTGCT | 83 | 2752 |
| 1103645 | N/A | N/A | 4389 | 4408 | TGCCTGCTCTTTCCCTCACT | 88 | 2753 |
| 1103661 | N/A | N/A | 4489 | 4508 | ATTTTATTATGACCACCGCT | 97 | 2754 |
| 1103677 | N/A | N/A | 4625 | 4644 | TCACTGTTGCACACACACAC | 124 | 2755 |
| 1103693 | N/A | N/A | 4775 | 4794 | GCAGGAGGATTAAGGGTTGG | 76 | 2756 |
| 1103709 | N/A | N/A | 5010 | 5029 | TGGGTGGCCATCAATCCTTT | 97 | 2757 |
| 1103725 | N/A | N/A | 5303 | 5322 | TCAGTTGCAATCTCTGTGTT | 65 | 2758 |
| 1103741 | N/A | N/A | 5394 | 5413 | ATTTCCTGTCTCTACCTGCC | 95 | 2759 |
| 1103757 | N/A | N/A | 5480 | 5499 | GTCCTCTTCTGCCTGCCCCT | 90 | 2760 |
| 1103773 | N/A | N/A | 5722 | 5741 | CAGGGCTACCTTGGAGCGGT | 71 | 2761 |
| 1103789 | N/A | N/A | 5848 | 5867 | TCTCACTTCTCTGGTGAAAG | 82 | 2762 |
| 1103805 | N/A | N/A | 5912 | 5931 | AGTAGCAGTAATAATAATGG | 86 | 2763 |
| 1103821 | N/A | N/A | 5973 | 5992 | AATCCATGAAAAGCACAGGG | 88 | 2764 |
| 1103837 | N/A | N/A | 6018 | 6037 | GGCTCTCTCATCTGTCAAAG | 24 | 2765 |
| 1103853 | N/A | N/A | 6198 | 6217 | CAGACACCTCTCTGTGTOCT | 108 | 2766 |
| 1103869 | N/A | N/A | 6256 | 6275 | TGTGGTGTTCTCTACGGGCA | 62 | 2767 |
| 1103885 | N/A | N/A | 6312 | 6331 | AAATGCCCCCTCTACAGTGT | 110 | 2768 |
| 1103901 | N/A | N/A | 6406 | 6425 | CTCTGTGCTTTTCTGCCTCC | 67 | 2769 |
| 1103917 | N/A | N/A | 6500 | 6519 | TCGGGCCCTCACCCTGCTCA | 92 | 2770 |
| 1103933 | N/A | N/A | 6902 | 6921 | GGCGAGCGGAGGCCTGGGTG | 12 | 2771 |
| 1103949 | N/A | N/A | 7016 | 7035 | ACCTCAGCACCTAGCACAAC | 90 | 2772 |
| 1103965 | N/A | N/A | 7197 | 7216 | TCAGGTCTGCAAACTAGGTG | 72 | 2773 |
| 1103981 | N/A | N/A | 7415 | 7434 | CCCCGCCCTCGACCCAGGTC | 131 | 2774 |
| 1103997 | N/A | N/A | 7804 | 7823 | ATGAGCTCTACCGTGAGGCA | 88 | 2775 |

TABLE 37-continued

Reduction of GFAP RNA by 5-10-5 MOE gapmers with mixed PO/PS internucleoside linkages in U251 cells

| Compound No. | SEQ ID NO: 1 Start Site | SEQ ID NO: 1 Stop Site | SEQ ID NO: 2 Start Site | SEQ ID NO: 2 Stop Site | Sequence (5' to 3') | GFAP (% UTC) | SEQ ID NO |
|---|---|---|---|---|---|---|---|
| 1104013 | N/A | N/A | 7913 | 7932 | ACATCTAGTGACTGOCTGCT | 94 | 2776 |
| 1104029 | N/A | N/A | 8034 | 8053 | AGGAGTCCAATCTTGGCTGG | 74 | 2777 |
| 1104045 | N/A | N/A | 8074 | 8093 | TGAAGAAAGTTCCAAGGAGG | 95 | 2778 |
| 1104061 | N/A | N/A | 8215 | 8234 | AAAGTCTAACTCCATCTCCT | 131 | 2779 |
| 1104077 | N/A | N/A | 9358 | 9377 | CCCGCCCCGCCCGAGAGAGA | 83 | 2780 |
| 1104093 | N/A | N/A | 9408 | 9427 | AATCATTTCAGGGCCAATGC | 24 | 2781 |
| 1104109 | N/A | N/A | 9451 | 9470 | ATATTCTAGTCCAGAAGAAG | 123 | 2782 |
| 1104125 | N/A | N/A | 9505 | 9524 | TAGCCTTTCTGATGCTGAAT | 57 | 2783 |
| 1104141 | N/A | N/A | 9529 | 9548 | ATTACCTCTACTAGTCAGCC | 59 | 2784 |
| 1104157 | N/A | N/A | 9556 | 9575 | ACCTGTGACTATCTAGGATT | 82 | 2785 |
| 1104173 | N/A | N/A | 9575 | 9594 | ATTTATCTGTGCTTTAGTGA | 41 | 2786 |
| 1104189 | N/A | N/A | 9652 | 9671 | ACATGTGGCACATATTAGTG | 98 | 2787 |
| 1104205 | N/A | N/A | 9705 | 9724 | CTACTTCTCTAGGTGGGAGA | 79 | 2788 |
| 1104221 | N/A | N/A | 10138 | 10157 | GAGTAAGACTCCGTCGAAAG | 89 | 2789 |
| 1104237 | N/A | N/A | 10608 | 10627 | TCAGCCCCTCTGCAAGCCCT | 85 | 2790 |
| 1104253 | N/A | N/A | 10732 | 10751 | TATGAGAACCTATGCAACCG | 72 | 2791 |
| 1104269 | N/A | N/A | 10808 | 10827 | TCTCATGGACTTTCAGGGCA | 112 | 2792 |
| 1104285 | N/A | N/A | 11077 | 11096 | ATTACATTCAGTTTCCTTGC | 103 | 2793 |
| 1104301 | N/A | N/A | 11148 | 11167 | AGGATCCCATCTAGTGGCTT | 91 | 2794 |
| 1104317 | N/A | N/A | 11224 | 11243 | ACTAACTTTAATTCTCTTTC | 96 | 2795 |
| 1104333 | N/A | N/A | 11274 | 11293 | AAAGCCCTCCCCATCCCCAA | 128 | 2796 |
| 1104349 | N/A | N/A | 11387 | 11406 | GGTAAGCTGCTGGAGTAAGA | 26 | 2797 |
| 1104365 | N/A | N/A | 11485 | 11504 | CTTACTTTTCTTGATAGTAA | 36 | 2798 |
| 1104381 | N/A | N/A | 11605 | 11624 | CTCCTTAATGACCTGCAGGG | 74 | 2799 |

TABLE 38

Reduction of GFAP RNA by 5-10-5 MOE gapmers with mixed PO/PS internucleoside linkages in U251 cells

| Compound Number | SEQ ID NO: 3 Start Site | SEQ ID NO: 3 Stop Site | Sequence (5' to 3') | GFAP (% UTC) | SEQ ID NO |
|---|---|---|---|---|---|
| 1103451 | 1220 | 1239 | CCCTCGAATCTGCAGGTTGG | 94 | 2800 |
| 1103452 | 1227 | 1246 | TTTTGCCCCCTCGAATCTGC | 106 | 2801 |
| 1103453 | 1228 | 1247 | CTTTTGCCCCCTCGAATCTG | 84 | 2802 |
| 1103454 | 1229 | 1248 | GCTTTTGCCCCCTCGAATCT | 95 | 2803 |
| 1103455 | 1231 | 1250 | GTGCTTTTGCCCCCTCGAAT | 59 | 2804 |

TABLE 38-continued

Reduction of GFAP RNA by 5-10-5 MOE gapmers with mixed PO/PS internucleoside linkages in U251 cells

| Compound Number | SEQ ID NO: 3 Start Site | SEQ ID NO: 3 Stop Site | Sequence (5' to 3') | GFAP (% UTC) | SEQ ID NO |
|---|---|---|---|---|---|
| 1103456 | 1233 | 1252 | TGGTGCTTTTGCCCCCTCGA | 92 | 2805 |
| 1103457 | 1235 | 1254 | TTTGGTGCTTTTGCCCCCTC | 60 | 2806 |
| 1103554 | 1813 | 1832 | TTAATATTTAACATTAAGAG | 77 | 2807 |
| 1047595 | 1222 | 1241 | CCCCCTCGAATCTGCAGGTT | 109 | 284 |
| 1047596 | 1223 | 1242 | GCCCCCTCGAATCTGCAGGT | 107 | 362 |

TABLE 38-continued

| Reduction of GFAP RNA by 5-10-5 MOE gapmers with mixed PO/PS internucleoside linkages in U251 cells | | | | | |
|---|---|---|---|---|---|
| Compound Number | SEQ ID NO: 3 Start Site | SEQ ID NO: 3 Stop Site | Sequence (5' to 3') | GFAP (% UTC) | SEQ ID NO |
| 1047597 | 1225 | 1244 | TTGCCCCCTCGAATCTGCAG | 65 | 440 |
| 1047598 | 1230 | 1249 | TGCTTTTGCCCCCTCGAATC | 115 | 518 |
| 1047599 | 1232 | 1251 | GGTGCTTTTGCCCCCTCGAA | 43 | 596 |
| 1047600 | 1234 | 1253 | TTGGTGCTTTTGCCCCCTCG | 86 | 674 |

Example 3: Effect of Modified Oligonucleotides on Human GFAP RNA In Vitro, Multiple Doses Modified oligonucleotides selected from the examples above were tested at various doses in U251 cells. Cultured U251 cells at a density of 10,000 cells per well were treated using free uptake with various concentrations of modified oligonucleotide as specified in the tables below. After a treatment period of approximately 48 hours, total RNA was isolated from the cells and GFAP RNA levels were measured by quantitative real-time RTPCR. Human GFAP primer probe set RTS37485 was used to measure RNA levels, as described above. GFAP RNA levels were adjusted according to total RNA content, as measured by RIBOGREEN®. Results are presented as percent of GFAP RNA, relative to untreated control cells (% control). Where possible, the half maximal inhibitory concentration ($IC_{50}$) of each modified oligonucleotide was calculated using a linear regression on a log/linear plot of the data in Excel. In some cases, an $IC_{50}$ could not be reliably calculated and the data point is marked as "NC". Modified oligonucleotides marked with an asterisk (*) indicate that the modified oligonucleotide is complementary to the amplicon region of the primer probe set. Additional assays may be used to measure the potency and efficacy of the modified oligonucleotides complementary to the amplicon region.

TABLE 39

Dose-dependent percent of human GFAP RNA compared to untreated control in U251 cells by modified oligonucleotides

| Compound No. | GFAP RNA (% control) 125 nM | 500 nM | 2000 nM | 8000 nM | $IC_{50}$ (μM) |
|---|---|---|---|---|---|
| 1047225 | 76 | 57 | 47 | 42 | 2.0 |
| 1047257 | 60 | 51 | 39 | 33 | 0.5 |
| 1047258 | 51 | 50 | 38 | 29 | 0.2 |
| 1047386 | 99 | 82 | 41 | 26 | 1.9 |
| 1047387 | 109 | 73 | 33 | 13 | 1.3 |
| 1047448 | 85 | 122 | 99 | 94 | NC |
| 1047466 | 107 | 82 | 77 | 46 | 7.8 |
| 1047497 | 120 | 117 | 107 | 136 | NC |
| 1047512 | 116 | 112 | 97 | 87 | NC |
| 1047584 | 94 | 54 | 23 | 10 | 0.8 |
| 1047608 | 125 | 133 | 79 | 52 | NC |
| 1047609 | 88 | 82 | 57 | 33 | 3.0 |
| 1047610 | 92 | 75 | 43 | 19 | 1.5 |
| 1047913 | 98 | 72 | 49 | 25 | 1.9 |
| 1048203 | 120 | 95 | 57 | 31 | 3.3 |
| 1048267 | 99 | 100 | 93 | 70 | NC |
| 1048296 | 99 | 91 | 73 | 72 | NC |

TABLE 39-continued

Dose-dependent percent of human GFAP RNA compared to untreated control in U251 cells by modified oligonucleotides

| Compound No. | GFAP RNA (% control) 125 nM | 500 nM | 2000 nM | 8000 nM | $IC_{50}$ (μM) |
|---|---|---|---|---|---|
| 1048344 | 77 | 97 | 88 | 86 | NC |
| 1048361 | 92 | 115 | 85 | 109 | NC |

TABLE 40

Dose-dependent percent of human GFAP RNA compared to untreated control in U251 cells by modified oligonucleotides

| Compound No. | GFAP RNA (% control) 125 nM | 500 nM | 2000 nM | 8000 nM | $IC_{50}$ (μM) |
|---|---|---|---|---|---|
| 1047325 | 81 | 86 | 76 | 67 | NC |
| 1047357 | 74 | 63 | 47 | 22 | 1.1 |
| 1047372 | 145 | 143 | 125 | 99 | NC |
| 1047373 | 105 | 73 | 43 | 21 | 1.7 |
| 1047374 | 150 | 122 | 84 | 46 | 7.3 |
| 1047388 | 108 | 116 | 62 | 32 | 4.2 |
| 1047500 | 100 | 105 | 74 | 60 | NC |
| 1047515 | 93 | 95 | 81 | 65 | NC |
| 1047518 | 125 | 99 | 81 | 51 | NC |
| 1047579 | 92 | 113 | 81 | 53 | NC |
| 1047580 | 96 | 88 | 58 | 41 | 4.3 |
| 1047581 | 73 | 60 | 32 | 17 | 0.7 |
| 1047582 | 72 | 29 | 12 | 7 | 0.3 |
| 1047584 | 100 | 60 | 23 | 11 | 0.6 |
| 1047613 | 107 | 107 | 79 | 44 | NC |
| 1047662 | 99 | 86 | 83 | 47 | NC |
| 1047707 | 100 | 126 | 91 | 75 | NC |
| 1048027 | 82 | 83 | 59 | 56 | NC |
| 1048350 | 104 | 85 | 57 | 36 | 3.4 |

TABLE 41

Dose-dependent percent of human GFAP RNA compared to untreated control in U251 cells by modified oligonucleotides

| Compound No. | GFAP RNA (% control) 125 nM | 500 nM | 2000 nM | 8000 nM | $IC_{50}$ (μM) |
|---|---|---|---|---|---|
| 1047235 | 80 | 81 | 68 | 57 | NC |
| 1047328 | 91 | 79 | 55 | 39 | 3.5 |
| 1047362 | 110 | 77 | 52 | 20 | 2.0 |
| 1047391 | 87 | 79 | 61 | 45 | 5.5 |
| 1047394 | 78 | 74 | 52 | 36 | 2.6 |
| 1047503 | 92 | 94 | 80 | 59 | NC |
| 1047522 | 81 | 81 | 63 | 50 | NC |
| 1047583 | 97 | 54 | 19 | 12 | 0.8 |
| 1047584 | 81 | 50 | 19 | 10 | 0.6 |
| 1047585 | 85 | 73 | 38 | 18 | 1.2 |
| 1047586 | 75 | 64 | 41 | 23 | 1.1 |
| 1047587 | 92 | 66 | 41 | 19 | 1.3 |
| 1047599 | 92 | 94 | 83 | 78 | NC |
| 1047601 | 103 | 89 | 68 | 50 | NC |
| 1047762 | 99 | 84 | 70 | 71 | NC |
| 1047955 | 95 | 104 | 86 | 92 | NC |
| 1048018 | 85 | 84 | 74 | 51 | NC |
| 1048351 | 98 | 97 | 75 | 59 | NC |
| 1048355 | 114 | 114 | 90 | 61 | NC |

TABLE 42

Dose-dependent percent of human GFAP RNA compared to untreated control in U251 cells by modified oligonucleotides

| Compound | GFAP RNA (% control) | | | | $IC_{50}$ |
|---|---|---|---|---|---|
| No. | 125 nM | 500 nM | 2000 nM | 8000 nM | (μM) |
| 1047429 | 80 | 58 | 32 | 15 | 0.8 |
| 1047444 | 80 | 98 | 83 | 73 | NC |
| 1047492 | 92 | 99 | 79 | 58 | NC |
| 1047573 | 80 | 74 | 59 | 44 | 4.7 |
| 1047584 | 87 | 53 | 20 | 8 | 0.7 |
| 1047588 | 69 | 49 | 24 | 14 | 0.5 |
| 1047589 | 101 | 79 | 47 | 24 | 2.0 |
| 1047590 | 70 | 55 | 35 | 24 | 0.7 |
| 1047591 | 92 | 67 | 34 | 21 | 1.2 |
| 1047734 | 86 | 75 | 69 | 60 | NC |
| 1047990 | 75 | 75 | 58 | 40 | 4.1 |
| 1048055 | 103 | 96 | 61 | 42 | 5.0 |
| 1048151 | 94 | 76 | 23 | 16 | 1.1 |
| 1048182 | 85 | 76 | 56 | 35 | 2.9 |
| 1048195 | 105 | 104 | 87 | 87 | NC |
| 1048196 | 94 | 91 | 73 | 62 | NC |
| 1048228 | 91 | 81 | 87 | 93 | NC |
| 1048341 | 80 | 71 | 61 | 46 | 6.1 |
| 1048372 | 94 | 88 | 84 | 59 | NC |

TABLE 43

Dose-dependent percent of human GFAP RNA compared to untreated control in U251 cells by modified oligonucleotides

| Compound | GFAP RNA (% control) | | | | $IC_{50}$ |
|---|---|---|---|---|---|
| No. | 125 nM | 500 nM | 2000 nM | 8000 nM | (μM) |
| 1047321 | 94 | 91 | 84 | 79 | NC |
| 1047337 | 94 | 89 | 68 | 61 | NC |
| 1047368 | 86 | 82 | 79 | 81 | NC |
| 1047385 | 86 | 80 | 63 | 58 | NC |
| 1047432 | 89 | 84 | 75 | 89 | NC |
| 1047465 | 82 | 67 | 62 | 49 | 7.3 |
| 1047469 | 104 | 95 | 73 | 58 | NC |
| 1047513 | 106 | 100 | 96 | 80 | NC |
| 1047576 | 82 | 83 | 63 | 49 | NC |
| 1047584 | 88 | 63 | 31 | 14 | 1.0 |
| 1047625 | 86 | 80 | 73 | 55 | NC |
| 1047675 | 101 | 88 | 92 | 82 | NC |
| 1047688 | 99 | 100 | 96 | 100 | NC |
| 1047705 | 100 | 92 | 78 | 68 | NC |
| 1047866 | 90 | 81 | 71 | 78 | NC |
| 1048125 | 103 | 91 | 86 | 84 | NC |
| 1048187 | 100 | 88 | 82 | 74 | NC |
| 1048188 | 99 | 64 | 80 | 81 | NC |
| 1048201 | 80 | 65 | 41 | 23 | 1.2 |

TABLE 44

Dose-dependent percent of human GFAP RNA compared to untreated control in U251 cells by modified oligonucleotides

| Compound | GFAP RNA (% control) | | | | $IC_{50}$ |
|---|---|---|---|---|---|
| No. | 125 nM | 500 nM | 2000 nM | 8000 nM | (μM) |
| 1047298 | 87 | 83 | 74 | 75 | NC |
| 1047474 | 102 | 93 | 94 | 87 | NC |
| 1047523 | 88 | 76 | 61 | 42 | 4.6 |
| 1047582 | 79 | 37 | 18 | 12 | 0.4 |
| 1047584 | 100 | 72 | 43 | 20 | 1.6 |
| 1047607 | 92 | 85 | 68 | 56 | NC |
| 1047717 | 106 | 110 | 92 | 80 | NC |
| 1047746 | 108 | 110 | 106 | 110 | NC |
| 1047790 | 91 | 86 | 81 | 70 | NC |
| 1047799 | 104 | 100 | 95 | 93 | NC |

TABLE 44-continued

Dose-dependent percent of human GFAP RNA compared to untreated control in U251 cells by modified oligonucleotides

| Compound | GFAP RNA (% control) | | | | $IC_{50}$ |
|---|---|---|---|---|---|
| No. | 125 nM | 500 nM | 2000 nM | 8000 nM | (μM) |
| 1047840 | 92 | 88 | 75 | 58 | NC |
| 1047859 | 96 | 87 | 87 | 78 | NC |
| 1047886 | 84 | 79 | 68 | 68 | NC |
| 1047907 | 97 | 90 | 80 | 71 | NC |
| 1048093 | 97 | 89 | 93 | 90 | NC |
| 1048144 | 101 | 93 | 99 | 108 | NC |
| 1048207 | 97 | 82 | 76 | 74 | NC |
| 1048223 | 91 | 77 | 77 | 68 | NC |
| 1048350 | 104 | 80 | 57 | 44 | 4.4 |

TABLE 45

Dose-dependent percent of human GFAP RNA compared to untreated control in U251 cells by modified oligonucleotides

| Compound | GFAP RNA (% control) | | | | IC50 |
|---|---|---|---|---|---|
| No. | 370 nM | 1111 nM | 3333 nM | 10000 nM | (μM) |
| 1047582 | 25 | 11 | 7 | 5 | NC |
| 1072814 | 62 | 45 | 22 | 14 | 0.7 |
| 1072815 | 86 | 57 | 42 | 28 | 2.3 |
| 1072818 | 78 | 54 | 33 | 16 | 1.5 |
| 1072834 | 33 | 22 | 13 | 8 | NC |
| 1072835 | 54 | 30 | 15 | 9 | NC |
| 1072855 | 64 | 44 | 27 | 16 | 0.8 |
| 1072862 | 59 | 40 | 20 | 9 | 0.6 |
| 1072863 | 83 | 54 | 35 | 20 | 1.7 |
| 1072868 | 80 | 50 | 23 | 9 | 1.2 |
| 1072872 | 21 | 13 | 9 | 7 | NC |
| 1072886 | 88 | 60 | 42 | 21 | 2.2 |
| 1072986 | 84 | 68 | 22 | 11 | 1.7 |
| 1073003 | 93 | 79 | 71 | 52 | NC |
| 1073034 | 97 | 80 | 30 | 30 | 2.9 |
| 1073035 | 78 | 80 | 41 | 27 | 2.8 |
| 1073063 | 53 | 29 | 15 | 7 | NC |
| 1073106 | 87 | 76 | 57 | 39 | 5.2 |
| 1073107 | 79 | 65 | 58 | 33 | 3.7 |

TABLE 46

Dose-dependent percent of human GFAP RNA compared to untreated control in U251 cells by modified oligonucleotides

| Compound | GFAP RNA (% control) | | | | IC50 |
|---|---|---|---|---|---|
| No. | 370 nM | 1111 nM | 3333 nM | 10000 nM | (μM) |
| 1047582 | 36 | 15 | 8 | 6 | NC |
| 1072813 | 69 | 58 | 36 | 17 | 1.4 |
| 1072824 | 85 | 63 | 38 | 23 | 2.2 |
| 1072849 | 66 | 32 | 21 | 14 | 0.6 |
| 1072853 | 116 | 98 | 70 | 24 | 5.1 |
| 1072856 | 90 | 57 | 32 | 14 | 1.8 |
| 1072857 | 66 | 45 | 32 | 17 | 1.0 |
| 1072861 | 68 | 45 | 28 | 16 | 1.0 |
| 1072864 | 87 | 62 | 43 | 22 | 2.3 |
| 1072973 | 101 | 74 | 40 | 13 | 2.5 |
| 1072980 | 39 | 45 | 27 | 16 | NC |
| 1073009 | 87 | 75 | 83 | 35 | 8.2 |
| 1073033 | 87 | 44 | 19 | 24 | 1.4 |
| 1073045 | 60 | 43 | 24 | 12 | 0.7 |
| 1073060 | 68 | 43 | 28 | 16 | 0.9 |
| 1073064 | 61 | 41 | 31 | 19 | 0.7 |
| 1073065 | 69 | 61 | 36 | 18 | 1.5 |
| 1073077 | 95 | 70 | 44 | 23 | 2.8 |
| 1073093 | 57 | 33 | 20 | 10 | 0.5 |

TABLE 47

Dose-dependent percent of human GFAP RNA compared to untreated control in U251 cells by modified oligonucleotides

| Compound No. | GFAP RNA (% control) 370 nM | 1111 nM | 3333 nM | 10000 nM | IC50 (μM) |
|---|---|---|---|---|---|
| 1047582 | 70 | 30 | 9 | 5 | 0.6 |
| 1103198 | 91 | 86 | 82 | 73 | NC |
| 1103246 | 102 | 84 | 81 | 62 | NC |
| 1103278 | 89 | 96 | 72 | 51 | NC |
| 1103279 | 86 | 69 | 43 | 30 | 2.9 |
| 1103359 | 82 | 75 | 55 | 39 | 5.0 |
| 1103470 | 86 | 88 | 73 | 55 | NC |
| 1103471 | 68 | 63 | 45 | 36 | 2.6 |
| 1103502 | 104 | 93 | 75 | 51 | NC |
| 1103567 | 88 | 66 | 45 | 23 | 2.5 |
| 1104014 | 91 | 91 | 56 | 56 | NC |
| 1104078 | 92 | 100 | 103 | 92 | NC |
| 1104127 | 67 | 52 | 42 | 33 | 1.6 |
| 1104144 | 93 | 63 | 34 | 16 | 2.1 |
| 1104158 | 50 | 51 | 55 | 23 | 1.0 |
| 1104159 | 65 | 59 | 40 | 25 | 1.6 |
| 1104174 | 91 | 93 | 63 | 43 | 7.9 |
| 1104175 | 69 | 46 | 23 | 13 | 0.9 |
| 1104191 | 84 | 76 | 52 | 34 | 4.0 |

TABLE 48

Dose-dependent percent of human GFAP RNA compared to untreated control in U251 cells by modified oligonucleotides

| Compound No. | GFAP RNA (% control) 370 nM | 1111 nM | 3333 nM | 10000 nM | IC50 (μM) |
|---|---|---|---|---|---|
| 1047582 | 66 | 30 | 11 | 6 | 0.6 |
| 1103202 | 79 | 79 | 54 | 43 | 6.0 |
| 1103217 | 77 | 38 | 16 | 5 | 0.9 |
| 1103218 | 92 | 74 | 50 | 33 | 3.7 |
| 1103330 | 84 | 79 | 56 | 51 | NC |
| 1103345 | 112 | 125 | 111 | 149 | NC |
| 1103377 | 115 | 134 | 142 | 151 | NC |
| 1103409 | 82 | 93 | 70 | 45 | NC |
| 1103570 | 79 | 64 | 43 | 24 | 2.3 |
| 1103571 | 101 | 74 | 61 | 34 | 4.6 |
| 1103872 | 93 | 79 | 28 | 21 | 2.4 |
| 1103970 | 88 | 78 | 75 | 74 | NC |
| 1104096 | 109 | 112 | 65 | 47 | 9.2 |
| 1104131 | 87 | 79 | 54 | 44 | 6.1 |
| 1104145 | 99 | 89 | 65 | 39 | 6.7 |
| 1104161 | 102 | 90 | 75 | 52 | NC |
| 1104178 | 72 | 67 | 57 | 53 | NC |
| 1104225 | 87 | 82 | 57 | 39 | 5.4 |
| 1104307 | 97 | 87 | 57 | 32 | 4.7 |

TABLE 49

Dose-dependent percent of human GFAP RNA compared to untreated control in U251 cells by modified oligonucleotides

| Compound No. | GFAP RNA (% control) 370 nM | 1111 nM | 3333 nM | 10000 nM | IC50 (μM) |
|---|---|---|---|---|---|
| 1047582 | 58 | 29 | 10 | 7 | 0.4 |
| 1103236 | 81 | 62 | 27 | 12 | 1.6 |
| 1103253 | 68 | 56 | 36 | 37 | 1.8 |
| 1103268 | 86 | 62 | 37 | 30 | 2.4 |
| 1103285 | 91 | 79 | 56 | 29 | 4.0 |
| 1103300 | 100 | 98 | 83 | 81 | NC |
| 1103365 | 83 | 86 | 64 | 42 | 8.2 |
| 1103428 | 87 | 73 | 50 | 26 | 3.2 |
| 1103491 | 86 | 70 | 70 | 55 | NC |
| 1103620 | 90 | 62 | 65 | 73 | NC |

TABLE 49-continued

Dose-dependent percent of human GFAP RNA compared to untreated control in U251 cells by modified oligonucleotides

| Compound No. | GFAP RNA (% control) 370 nM | 1111 nM | 3333 nM | 10000 nM | IC50 (μM) |
|---|---|---|---|---|---|
| 1104037 | 77 | 92 | 66 | 38 | 7.8 |
| 1104116 | 85 | 63 | 42 | 23 | 2.3 |
| 1104118 | 99 | 74 | 38 | 20 | 2.6 |
| 1104132 | 107 | 79 | 53 | 35 | 4.5 |
| 1104133 | 70 | 67 | 43 | 29 | 2.3 |
| 1104165 | 91 | 86 | 59 | 32 | 4.8 |
| 1104276 | 94 | 71 | 18 | 15 | 1.9 |
| 1104309 | 73 | 60 | 36 | 20 | 1.6 |
| 1104310 | 82 | 57 | 30 | 13 | 1.6 |

TABLE 50

Dose-dependent percent of human GFAP RNA compared to untreated control in U251 cells by modified oligonucleotides

| Compound No. | GFAP RNA (% control) 370 nM | 1111 nM | 3333 nM | 10000 nM | IC50 (μM) |
|---|---|---|---|---|---|
| 1047582 | 69 | 30 | 11 | 7 | 0.6 |
| 1103241 | 87 | 71 | 60 | 50 | NC |
| 1103257 | 75 | 83 | 47 | 26 | 3.1 |
| 1103258 | 81 | 70 | 44 | 23 | 2.4 |
| 1103272 | 94 | 91 | 52 | 26 | 4.0 |
| 1103369 | 88 | 78 | 59 | 38 | 5.4 |
| 1103370 | 83 | 88 | 59 | 44 | 8.0 |
| 1103400 | 95 | 101 | 87 | 76 | NC |
| 1103448 | 91 | 73 | 49 | 32 | 3.6 |
| 1103465 | 88 | 68 | 47 | 31 | 3.1 |
| 1103592 | 96 | 111 | 75 | 48 | NC |
| 1103722* | 21 | 24 | 21 | 19 | NC |
| 1103816 | 108 | 118 | 95 | 76 | NC |
| 1104072 | 111 | 83 | 63 | 17 | 3.8 |
| 1104122 | 84 | 73 | 65 | 48 | NC |
| 1104153 | 78 | 83 | 55 | 50 | NC |
| 1104280 | 111 | 84 | 55 | 25 | 3.9 |
| 1104312 | 91 | 71 | 52 | 32 | 3.7 |
| 1104361 | 87 | 81 | 65 | 42 | 7.4 |

TABLE 51

Dose-dependent percent of human GFAP RNA compared to untreated control in U251 cells by modified oligonucleotides

| Compound No. | GFAP RNA (% control) 370 nM | 1111 nM | 3333 nM | 10000 nM | IC50 (μM) |
|---|---|---|---|---|---|
| 1047582 | 60 | 36 | 12 | 8 | 0.5 |
| 1103244 | 99 | 79 | 55 | 42 | 5.7 |
| 1103259 | 85 | 70 | 42 | 26 | 2.6 |
| 1103322 | 87 | 82 | 66 | 46 | 9.5 |
| 1103371 | 86 | 97 | 64 | 38 | 7.3 |
| 1103516 | 104 | 123 | 90 | 69 | NC |
| 1103837 | 82 | 62 | 40 | 26 | 2.2 |
| 1103899 | 94 | 87 | 68 | 48 | NC |
| 1103932 | 74 | 83 | 68 | 64 | NC |
| 1103933 | 79 | 63 | 11 | 9 | 1.3 |
| 1104093 | 90 | 61 | 33 | 24 | 2.1 |
| 1104123 | 91 | 114 | 81 | 61 | NC |
| 1104156 | 83 | 86 | 71 | 55 | NC |
| 1104173 | 87 | 89 | 60 | 42 | 7.2 |
| 1104298 | 105 | 102 | 80 | 57 | NC |
| 1104299 | 101 | 109 | 84 | 72 | NC |
| 1104349 | 104 | 71 | 57 | 35 | 4.3 |
| 1104365 | 95 | 75 | 63 | 40 | 5.8 |
| 1104380 | 95 | 83 | 61 | 45 | 7.3 |

TABLE 52

| Dose-dependent percent of human GFAP RNA compared to untreated control in U251 cells by modified oligonucleotides | | | | | |
|---|---|---|---|---|---|
| Compound | GFAP RNA (% control) | | | | IC50 |
| No. | 370 nM | 1111 nM | 3333 nM | 10000 nM | (μM) |
| 1047582 | 63 | 26 | 10 | 6 | 0.5 |
| 1103254 | 93 | 85 | 62 | 37 | 5.8 |
| 1103255 | 59 | 49 | 23 | 14 | 0.8 |
| 1103256 | 84 | 54 | 22 | 10 | 1.4 |
| 1103366 | 105 | 79 | 58 | 58 | NC |
| 1103368 | 92 | 79 | 44 | 21 | 2.9 |
| 1103430 | 97 | 86 | 60 | 42 | 6.3 |
| 1103446 | 84 | 79 | 51 | 36 | 4.3 |
| 1103447 | 88 | 79 | 49 | 32 | 3.7 |
| 1103478 | 90 | 95 | 62 | 46 | 9.1 |
| 1103558 | 82 | 92 | 59 | 32 | 5.2 |
| 1103591 | 73 | 69 | 51 | 31 | 3.0 |
| 1104038 | 68 | 51 | 31 | 36 | 1.4 |
| 1104039 | 80 | 68 | 43 | 36 | 3.1 |
| 1104151 | 80 | 65 | 46 | 28 | 2.6 |
| 1104152 | 94 | 71 | 47 | 22 | 2.8 |
| 1104166 | 94 | 70 | 45 | 27 | 3.0 |
| 1104311 | 70 | 60 | 40 | 22 | 1.7 |
| 1104326 | 97 | 85 | 64 | 52 | NC |

Example 4: Tolerability of Modified Oligonucleotides Complementary to Human GFAP in Wild-Type Mice, 3 Hour Study Modified oligonucleotides described above were tested in wild-type female C57/Bl6 mice to assess the tolerability of the oligonucleotides. Wild-type female C57/Bl6 mice each received a single ICV dose of 700 μg of modified oligonucleotide listed in the table below. Each treatment group consisted of 4 mice. A group of 4 mice received PBS as a negative control for each experiment (identified in separate tables below). At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the tables below.

TABLE 53

| Tolerability scores in mice at 700 μg dose | |
|---|---|
| Compound No. | 3 hr. FOB |
| PBS | 0 |
| 1047198 | 3 |
| 1047258 | 3 |
| 1047328 | 7 |
| 1047362 | 0 |
| 1047373 | 0 |
| 1047386 | 4 |
| 1047387 | 0 |
| 1047388 | 2 |
| 1047391 | 5 |
| 1047580 | 0 |
| 1047582 | 5 |
| 1047583 | 2 |
| 1047584 | 1 |
| 1047585 | 0 |
| 1047586 | 0 |
| 1047587 | 0 |
| 1047588 | 0 |
| 1047589 | 1 |
| 1047590 | 2 |
| 1047591 | 4 |
| 1047610 | 5 |
| 1048203 | 5 |
| 1048267 | 6 |
| 1048350 | 4 |

TABLE 54

| Tolerability scores in mice at 700 μg dose | |
|---|---|
| Compound No. | 3 hr. FOB |
| PBS | 0 |
| 1047257 | 5 |
| 1047357 | 7 |
| 1047374 | 5 |
| 1047394 | 6 |
| 1047429 | 0 |
| 1047444 | 2 |
| 1047448 | 0 |
| 1047492 | 2 |
| 1047497 | 2 |
| 1047500 | 1 |
| 1047518 | 5 |
| 1047573 | 1 |
| 1047581 | 1 |
| 1047599 | 1 |
| 1047601 | 6 |
| 1047608 | 2 |
| 1047609 | 5 |
| 1047913 | 1 |
| 1047990 | 2 |
| 1048027 | 2 |
| 1048151 | 4 |
| 1048182 | 0 |
| 1048296 | 3 |
| 1048361 | 0 |

TABLE 55

| Tolerability scores in mice at 700 μg dose | |
|---|---|
| Compound No. | 3 hr. FOB |
| PBS | 0 |
| 1047211 | 2 |
| 1047223 | 0 |
| 1047225 | 1 |
| 1047298 | 0 |
| 1047306 | 0 |
| 1047316 | 2 |
| 1047352 | 4 |
| 1047353 | 2 |
| 1047402 | 2 |
| 1047432 | 0 |

TABLE 55-continued

| Tolerability scores in mice at 700 μg dose | |
|---|---|
| Compound No. | 3 hr. FOB |
| 1047522 | 0 |
| 1047523 | 2 |
| 1047532 | 2 |
| 1047579 | 2 |
| 1047598 | 4 |
| 1047602 | 5 |
| 1047662 | 4 |
| 1047679 | 2 |
| 1047711 | 2 |
| 1047811 | 0 |
| 1047884 | 3 |
| 1048201 | 1 |
| 1048204 | 0 |
| 1048227 | 1 |

TABLE 56

| Tolerability scores in mice at 700 μg dose | |
|---|---|
| Compound No. | 3 hr. FOB |
| PBS | 0 |
| 1072813 | 0 |
| 1072814 | 1 |
| 1072818 | 4 |
| 1072834 | 4 |
| 1072835 | 0 |
| 1072849 | 5 |
| 1072855 | 4 |
| 1072856 | 6 |
| 1072857 | 4 |
| 1072861 | 6 |
| 1072862 | 4 |
| 1072863 | 3 |
| 1072868 | 7 |
| 1072872 | 5 |
| 1072886 | 1 |
| 1072980 | 1 |
| 1072986 | 6 |
| 1073033 | 5 |
| 1073045 | 6 |
| 1073060 | 6 |
| 1073063 | 6 |
| 1073064 | 6 |
| 1073065 | 6 |
| 1073093 | 6 |

TABLE 57

| Tolerability scores in mice at 700 μg dose | |
|---|---|
| Compound No. | 3 hr. FOB |
| PBS | 0 |
| 1103217 | 5 |
| 1103368 | 3 |
| 1103370 | 3 |
| 1103371 | 3 |
| 1103465 | 6 |
| 1103502 | 5 |
| 1103516 | 7 |
| 1103567 | 5 |
| 1103837 | 4 |
| 1103899 | 2 |
| 1104093 | 5 |

TABLE 57-continued

| Tolerability scores in mice at 700 μg dose | |
|---|---|
| Compound No. | 3 hr. FOB |
| 1104118 | 6 |
| 1104133 | 6 |
| 1104145 | 2 |
| 1104152 | 5 |
| 1104158 | 3 |
| 1104166 | 5 |
| 1104168 | 4 |
| 1104175 | 6 |
| 1104307 | 4 |
| 1104309 | 5 |
| 1104310 | 6 |
| 1104311 | 5 |
| 1104349 | 7 |

TABLE 58

| Tolerability scores in mice at 700 μg dose | |
|---|---|
| Compound No. | 3 hr. FOB |
| PBS | 0 |
| 1103202 | 5 |
| 1103218 | 7 |
| 1103253 | 7 |
| 1103255 | 7 |
| 1103256 | 7 |
| 1103257 | 6 |
| 1103258 | 7 |
| 1103259 | 6 |
| 1103268 | 1 |
| 1103279 | 6 |
| 1103285 | 7 |
| 1103411 | 7 |
| 1103471 | 6 |
| 1103570 | 6 |
| 1103722 | 1 |
| 1103872 | 4 |
| 1103933 | 7 |
| 1104038 | 7 |
| 1104116 | 1 |
| 1104127 | 3 |
| 1104144 | 3 |
| 1104159 | 5 |
| 1104276 | 1 |

Example 5: Design of MOE Gapmer Modified Oligonucleotides with Mixed PO/PS Internucleoside Linkages Complementary to a Human GFAP Nucleic Acid Modified oligonucleotides complementary to human GFAP nucleic acid were designed. The modified oligonucleotides in the table below are 6-10-4 MOE gapmers. The gapmers are 20 nucleosides in length and have a central gap segment that consists of ten 2'-β-D-deoxynucleosides, a 5' wing segment that consists of six 2'-β-D-MOE nucleosides, and a 3' wing segment that consists of four 2'-β-D-MOE nucleosides. The sugar motif of the gapmers is (from 5' to 3): eeeeeeddddddddddeeee: wherein 'd' represents a 2'-β-D-deoxyribosyl sugar moiety, and 'e' represents a 2'-β-D-MOE sugar moiety. The gapmers have an internucleoside linkage motif of (from 5' to 3'): sooooossssssssssoss; wherein each "s" represents a phosphorothioate internucleoside linkage and each "o" represents a phosphodiester internucleoside linkage. Each cytosine nucleoside is a 5-methylcytosine.

TABLE 59

6-10-4 MOE gapmers with mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166991 | CAGCCTGGTTAGCCTTTCTG | N/A | N/A | 9514 | 9533 | 2017 |
| 1166992 | TCAGCCTGGTTAGCCTTTCT | N/A | N/A | 9515 | 9534 | 2094 |
| 1166993 | GTCAGCCTGGTTAGCCTTTC | N/A | N/A | 9516 | 9535 | 2171 |
| 1166994 | AGTCAGCCTGGTTAGCCTTT | N/A | N/A | 9517 | 9536 | 1484 |
| 1166996 | CTAGTCAGCCTGGTTAGCCT | N/A | N/A | 9519 | 9538 | 1561 |
| 1166997 | ACTAGTCAGCCTGGTTAGCC | N/A | N/A | 9520 | 9539 | 2325 |
| 1166998 | CAGTATTACCTCTACTAGTC | N/A | N/A | 9533 | 9552 | 20 |
| 1166999 | GCAGTATTACCTCTACTAGT | N/A | N/A | 9534 | 9553 | 88 |
| 1167000 | GGCAGTATTACCTCTACTAG | N/A | N/A | 9535 | 9554 | 1637 |
| 1167001 | TGGCAGTATTACCTCTACTA | N/A | N/A | 9536 | 9555 | 166 |
| 1167002 | TTGGCAGTATTACCTCTACT | N/A | N/A | 9537 | 9556 | 1865 |
| 1167003 | TTTGGCAGTATTACCTCTAC | N/A | N/A | 9538 | 9557 | 1941 |
| 1167004 | ATTTGGCAGTATTACCTCTA | N/A | N/A | 9539 | 9558 | 2018 |
| 1167024 | GTGTATTAGGATCCCATCTA | N/A | N/A | 11155 | 11174 | 2028 |
| 1167025 | TGTGTATTAGGATCCCATCT | N/A | N/A | 11156 | 11175 | 2105 |
| 1167026 | GTGTGTATTAGGATCCCATC | N/A | N/A | 11157 | 11176 | 1569 |
| 1167027 | AGTGTGTATTAGGATCCCAT | N/A | N/A | 11158 | 11177 | 2182 |
| 1167050 | CTTTATTTTTCCTCAGCGAC | 3045 | 3064 | 13334 | 13353 | 361 |
| 1167051 | TCTTTATTTTTCCTCAGCGA | 3046 | 3065 | 13335 | 13354 | 439 |
| 1167053 | TGTCTTTATTTTTCCTCAGC | 3048 | 3067 | 13337 | 13356 | 595 |
| 1167054 | TTGTCTTTATTTTTCCTCAG | 3049 | 3068 | 13338 | 13357 | 673 |
| 1167055 | TTTGTCTTTATTTTTCCTCA | 3050 | 3069 | 13339 | 13358 | 751 |
| 1167056 | ATTTGTCTTTATTTTTCCTC | 3051 | 3070 | 13340 | 13359 | 829 |
| 1166975 | TTGTGATTTTCCCCGTCTTT | N/A | N/A | 8755 | 8774 | 908 |
| 1166984 | ACATTCACTAATATTTAACA | N/A | N/A | 9323 | 9342 | 1022 |
| 1166985 | CACATTCACTAATATTTAAC | N/A | N/A | 9324 | 9343 | 21 |
| 1166986 | TCACATTCACTAATATTTAA | N/A | N/A | 9325 | 9344 | 2321 |
| 1166987 | GTCACATTCACTAATATTTA | N/A | N/A | 9326 | 9345 | 1177 |
| 1166988 | CGTCACATTCACTAATATTT | N/A | N/A | 9327 | 9346 | 2398 |
| 1166989 | ACGTCACATTCACTAATATT | N/A | N/A | 9328 | 9347 | 2808 |
| 1166990 | CACGTCACATTCACTAATAT | N/A | N/A | 9329 | 9348 | 2809 |
| 1167057 | CATTTGTCTTTATTTTTCCT | 3052 | 3071 | 13341 | 13360 | 907 |
| 1167059 | AGCATTTGTCTTTATTTTTC | 3054 | 3073 | 13343 | 13362 | 1063 |
| 1167060 | CAGCATTTGTCTTTATTTTT | 3055 | 3074 | 13344 | 13363 | 1140 |
| 1166982 | GCTTTTGAGATATCTTGTGA | N/A | N/A | 8777 | 8796 | 51 |
| 1167007 | TGACTATCTAGGATTTGGCA | N/A | N/A | 9551 | 9570 | 2480 |
| 1167011 | CCTGTGACTATCTAGGATTT | N/A | N/A | 9555 | 9574 | 2709 |

TABLE 59-continued 6-10-4 MOE gapmers with mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1167012 | TTTATCTGTGCTTTAGTGAC | N/A | N/A | 9574 | 9593 | 2710 |
| 1167017 | TGCCATTTATCTGTGCTTTA | N/A | N/A | 9579 | 9598 | 1639 |
| 1167018 | CTGCCATTTATCTGTGCTTT | N/A | N/A | 9580 | 9599 | 1867 |
| 1174062 | GCTTTTGCCCCCTGTAGTGA | N/A | N/A | 8732 | 8751 | 2291 |
| 1174063 | GTGCTTTTGCCCCCTGTAGT | N/A | N/A | 8734 | 8753 | 2368 |
| 1174065 | TGGTGCTTTTGCCCCCTGTA | N/A | N/A | 8736 | 8755 | 2445 |
| 1174066 | TTGGTGCTTTTGCCCCCTGT | N/A | N/A | 8737 | 8756 | 59 |
| 1167033 | GCACAGTTCCCAGATACTOC | 1756 | 1775 | 12045 | 12064 | 426 |
| 1167034 | GGCACAGTTCCCAGATACTC | 1757 | 1776 | 12046 | 12065 | 504 |
| 1167035 | AGGCACAGTTCCCAGATACT | 1758 | 1777 | 12047 | 12066 | 1425 |
| 1167036 | AAGGCACAGTTCCCAGATAC | 1759 | 1778 | 12048 | 12067 | 1502 |
| 1167037 | AAAGGCACAGTTCCCAGATA | 1760 | 1779 | 12049 | 12068 | 582 |
| 1167040 | CTCAGTTTTCCTCCAGCAGC | 1792 | 1811 | 12081 | 12100 | 115 |
| 1167046 | GCCAGTGTCTTCACTTTGCT | 2750 | 2769 | 13039 | 13058 | 1973 |
| 1167058 | GCATTTGTCTTTATTTTTCC | 3053 | 3072 | 13342 | 13361 | 985 |

Modified oligonucleotides in the table below are 5-10-5 MOE gapmers with mixed PO/PS internucleoside linkages. The gapmers are 20 nucleosides in length, wherein the central gap segment consists of ten 2'β-D-deoxynucleosides and the 5' and 3' wing segments each consists of five 2'-β-D-MOE modified nucleosides. The sugar motif for the gapmers is (from 5' to 3'): eeeeeddddddddddeeeee; wherein 'd' represents a 2'-β-D-deoxyribose sugar moiety, and 'e' represents a 2'-β-D-MOE sugar moeity. The gapmers have an internucleoside linkage motif of (from 5' to 3'): soooossssssssssooss; wherein each "s" represents a phosphorothioate internucleoside linkage and each "o" represents a phosphodiester internucleoside linkage. Each cytosine nucleoside is a 5-methylcytosine.

TABLE 60

5-10-5 MOE gapmers with a mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166900 | CAGCCTGGTTAGCCTTTCTG | N/A | N/A | 9514 | 9533 | 2017 |
| 1166901 | TCAGCCTGGTTAGCCTTTCT | N/A | N/A | 9515 | 9534 | 2094 |
| 1166902 | GTCAGCCTGGTTAGCCTTTC | N/A | N/A | 9516 | 9535 | 2171 |
| 1166903 | AGTCAGCCTGGTTAGCCTTT | N/A | N/A | 9517 | 9536 | 1484 |
| 1166904 | TAGTCAGCCTGGTTAGCCTT | N/A | N/A | 9518 | 9537 | 2248 |
| 1166905 | CTAGTCAGCCTGGTTAGCCT | N/A | N/A | 9519 | 9538 | 1561 |
| 1166906 | ACTAGTCAGCCTGGTTAGCC | N/A | N/A | 9520 | 9539 | 2325 |
| 1166907 | CAGTATTACCTCTACTAGTC | N/A | N/A | 9533 | 9552 | 20 |
| 1166909 | GGCAGTATTACCTCTACTAG | N/A | N/A | 9535 | 9554 | 1637 |
| 1166910 | TGGCAGTATTACCTCTACTA | N/A | N/A | 9536 | 9555 | 166 |
| 1166911 | TTGGCAGTATTACCTCTACT | N/A | N/A | 9537 | 9556 | 1865 |

TABLE 60-continued 5-10-5 MOE gapmers with a mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166912 | TTTGGCAGTATTACCTCTAC | N/A | N/A | 9538 | 9557 | 1941 |
| 1166913 | ATTTGGCAGTATTACCTCTA | N/A | N/A | 9539 | 9558 | 2018 |
| 1166932 | TGTATTAGGATCCCATCTAG | N/A | N/A | 11154 | 11173 | 1951 |
| 1166933 | GTGTATTAGGATCCCATCTA | N/A | N/A | 11155 | 11174 | 2028 |
| 1166934 | TGTGTATTAGGATCCCATCT | N/A | N/A | 11156 | 11175 | 2105 |
| 1166885 | CTTGTGATTTTCCCCGTCTT | N/A | N/A | 8756 | 8775 | 986 |
| 1166886 | CCTTGTGATTTTCCCCGTCT | N/A | N/A | 8757 | 8776 | 1064 |
| 1166887 | TTGAGATATCTTGTGACCTT | N/A | N/A | 8773 | 8792 | 1510 |
| 1166888 | TTTGAGATATCTTGTGACCT | N/A | N/A | 8774 | 8793 | 1280 |
| 1166890 | CTTTTGAGATATCTTGTGAC | N/A | N/A | 8776 | 8795 | 1434 |
| 1166893 | ACATTCACTAATATTTAACA | N/A | N/A | 9323 | 9342 | 1022 |
| 1166894 | CACATTCACTAATATTTAAC | N/A | N/A | 9324 | 9343 | 21 |
| 1166895 | TCACATTCACTAATATTTAA | N/A | N/A | 9325 | 9344 | 2321 |
| 1166896 | GTCACATTCACTAATATTTA | N/A | N/A | 9326 | 9345 | 1177 |
| 1166897 | CGTCACATTCACTAATATTT | N/A | N/A | 9327 | 9346 | 2398 |
| 1166898 | ACGTCACATTCACTAATATT | N/A | N/A | 9328 | 9347 | 2808 |
| 1166899 | CACGTCACATTCACTAATAT | N/A | N/A | 9329 | 9348 | 2809 |
| 1166916 | TGACTATCTAGGATTTGGCA | N/A | N/A | 9551 | 9570 | 2480 |
| 1166920 | CCTGTGACTATCTAGGATTT | N/A | N/A | 9555 | 9574 | 2709 |
| 1166926 | TGCCATTTATCTGTGCTTTA | N/A | N/A | 9579 | 9598 | 1639 |
| 1166927 | CTGCCATTTATCTGTGCTTT | N/A | N/A | 9580 | 9599 | 1867 |
| 1166928 | TCTGCCATTTATCTGTGCTT | N/A | N/A | 9581 | 9600 | 400 |
| 1166929 | CTCTGCCATTTATCTGTGCT | N/A | N/A | 9582 | 9601 | 1943 |
| 1174056 | GCTTTTGCCCCCTGTAGTGA | N/A | N/A | 8732 | 8751 | 2291 |
| 1174058 | GGTGCTTTTGCCCCCTGTAG | N/A | N/A | 8735 | 8754 | 1227 |
| 1174059 | TGGTGCTTTTGCCCCCTGTA | N/A | N/A | 8736 | 8755 | 2445 |
| 1174060 | TTGGTGCTTTTGCCCCCTGT | N/A | N/A | 8737 | 8756 | 59 |
| 1174061 | TTTGGTGCTTTTGCCCCCTG | N/A | N/A | 8738 | 8757 | 2522 |
| 1166940 | ACAGTTCCCAGATACTCCGA | 1754 | 1773 | 12043 | 12062 | 270 |
| 1166946 | AAAGGCACAGTTCCCAGATA | 1760 | 1779 | 12049 | 12068 | 582 |
| 1166948 | TCAGTTTTCCTCCAGCAGCC | 1791 | 1810 | 12080 | 12099 | 37 |
| 1166954 | CCAGTGTCTTCACTTTGCTC | 2749 | 2768 | 13038 | 13057 | 825 |
| 1199982 | GGTCCTAAATATTCTAGTCC | N/A | N/A | 9459 | 9478 | 2093 |
| 1199983 | TGGTCCTAAATATTCTAGTC | N/A | N/A | 9460 | 9479 | 2170 |
| 1199984 | GTGGTCCTAAATATTCTAGT | N/A | N/A | 9461 | 9480 | 2813 |

The modified oligonucleotides in the table below are 4-10-6 MOE gapmers. The gapmers are 20 nucleosides in length and have a central gap segment that consists of ten 2'-β-D-deoxynucleosides, a 5' wing segment that consists of four 2'-β-D-MOE nucleosides, and a 3' wing segment that consists of six 2'-β-D-MOE nucleosides. The sugar motif of the gapmers is (from 5' to 3): eceeeddddddddddkeeecee; wherein 'd' represents a 2'-β-D-deoxyribosyl sugar moiety, and 'e' represents a 2'-β-D-MOE sugar moiety. The gapmers have an internucleoside linkage motif of (from 5' to 3'): sooosssssssssssoooss; wherein "s" represents a phosphonothioate internucleoside linkage and "o" represents a phosphodiester internucleoside linkage. Each cytosine nucleoside is a 5-methylcytosine.

TABLE 61

4-10-6 MOE gapmers with a mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166809 | CAGCCTGGTTAGCCTTTCTG | N/A | N/A | 9514 | 9533 | 2017 |
| 1166810 | TCAGCCTGGTTAGCCTTTCT | N/A | N/A | 9515 | 9534 | 2094 |
| 1166812 | AGTCAGCCTGGTTAGCCTTT | N/A | N/A | 9517 | 9536 | 1484 |
| 1166813 | TAGTCAGCCTGGTTAGCCTT | N/A | N/A | 9518 | 9537 | 2248 |
| 1166814 | CTAGTCAGCCTGGTTAGCCT | N/A | N/A | 9519 | 9538 | 1561 |
| 1166815 | ACTAGTCAGCCTGGTTAGCC | N/A | N/A | 9520 | 9539 | 2325 |
| 1166816 | CAGTATTACCTCTACTAGTC | N/A | N/A | 9533 | 9552 | 20 |
| 1166817 | GCAGTATTACCTCTACTAGT | N/A | N/A | 9534 | 9553 | 88 |
| 1166818 | GGCAGTATTACCTCTACTAG | N/A | N/A | 9535 | 9554 | 1637 |
| 1166819 | TGGCAGTATTACCTCTACTA | N/A | N/A | 9536 | 9555 | 166 |
| 1166820 | TTGGCAGTATTACCTCTACT | N/A | N/A | 9537 | 9556 | 1865 |
| 1166821 | TTTGGCAGTATTACCTCTAC | N/A | N/A | 9538 | 9557 | 1941 |
| 1166822 | ATTTGGCAGTATTACCTCTA | N/A | N/A | 9539 | 9558 | 2018 |
| 1166841 | TGTATTAGGATCCCATCTAG | N/A | N/A | 11154 | 11173 | 1951 |
| 1166842 | GTGTATTAGGATCCCATCTA | N/A | N/A | 11155 | 11174 | 2028 |
| 1166843 | TGTGTATTAGGATCCCATCT | N/A | N/A | 11156 | 11175 | 2105 |
| 1166845 | AGTGTGTATTAGGATCCCAT | N/A | N/A | 11158 | 11177 | 2182 |
| 1166846 | GAGTGTGTATTAGGATCCCA | N/A | N/A | 11159 | 11178 | 2259 |
| 1166847 | AGAGTGTGTATTAGGATCCC | N/A | N/A | 11160 | 11179 | 2336 |
| 1166869 | TCTTTATTTTTCCTCAGCGA | 3046 | 3065 | 13335 | 13354 | 439 |
| 1166870 | GTCTTTATTTTTCCTCAGCG | 3047 | 3066 | 13336 | 13355 | 517 |
| 1166871 | TGTCTTTATTTTTCCTCAGC | 3048 | 3067 | 13337 | 13356 | 595 |
| 1166872 | TTGTCTTTATTTTTCCTCAG | 3049 | 3068 | 13338 | 13357 | 673 |
| 1166873 | TTTGTCTTTATTTTTCCTCA | 3050 | 3069 | 13339 | 13358 | 751 |
| 1166874 | ATTTGTCTTTATTTTTCCTC | 3051 | 3070 | 13340 | 13359 | 829 |
| 1166793 | TTGTGATTTTCCCCGTCTTT | N/A | N/A | 8755 | 8774 | 908 |
| 1166794 | CTTGTGATTTTCCCCGTCTT | N/A | N/A | 8756 | 8775 | 986 |
| 1166795 | CCTTGTGATTTTCCCCGTCT | N/A | N/A | 8757 | 8776 | 1064 |
| 1166798 | TTTTGAGATATCTTGTGACC | N/A | N/A | 8775 | 8794 | 1357 |
| 1166799 | CTTTTGAGATATCTTGTGAC | N/A | N/A | 8776 | 8795 | 1434 |
| 1166800 | GCTTTTGAGATATCTTGTGA | N/A | N/A | 8777 | 8796 | 51 |
| 1166802 | ACATTCACTAATATTTAACA | N/A | N/A | 9323 | 9342 | 1022 |

TABLE 61-continued 4-10-6 MOE gapmers with a mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166803 | CACATTCACTAATATTTAAC | N/A | N/A | 9324 | 9343 | 21 |
| 1166804 | TCACATTCACTAATATTTAA | N/A | N/A | 9325 | 9344 | 2321 |
| 1166805 | GTCACATTCACTAATATTTA | N/A | N/A | 9326 | 9345 | 1177 |
| 1166806 | CGTCACATTCACTAATATTT | N/A | N/A | 9327 | 9346 | 2398 |
| 1166807 | ACGTCACATTCACTAATATT | N/A | N/A | 9328 | 9347 | 2808 |
| 1166808 | CACGTCACATTCACTAATAT | N/A | N/A | 9329 | 9348 | 2809 |
| 1166867 | TTTATTTTTCCTCAGCGACT | 3044 | 3063 | 13333 | 13352 | 283 |
| 1166875 | CATTTGTCTTTATTTTTCCT | 3052 | 3071 | 13341 | 13360 | 907 |
| 1166877 | AGCATTTGTCTTTATTTTTC | 3054 | 3073 | 13343 | 13362 | 1063 |
| 1166878 | CAGCATTTGTCTTTATTTTT | 3055 | 3074 | 13344 | 13363 | 1140 |
| 1166823 | ACTATCTAGGATTTGGCAGT | N/A | N/A | 9549 | 9568 | 2326 |
| 1166826 | GTGACTATCTAGGATTTGGC | N/A | N/A | 9552 | 9571 | 1408 |
| 1166831 | ATTTATCTGTGCTTTAGTGA | N/A | N/A | 9575 | 9594 | 2786 |
| 1166835 | TGCCATTTATCTGTGCTTTA | N/A | N/A | 9579 | 9598 | 1639 |
| 1174050 | GCTTTTGCCCCCTGTAGTGA | N/A | N/A | 8732 | 8751 | 2291 |
| 1174051 | GTGCTTTTGCCCCCTGTAGT | N/A | N/A | 8734 | 8753 | 2368 |
| 1174053 | TGGTGCTTTTGCCCCCTGTA | N/A | N/A | 8736 | 8755 | 2445 |
| 1174054 | TTGGTGCTTTTGCCCCCTGT | N/A | N/A | 8737 | 8756 | 59 |
| 1166852 | GGCACAGTTCCCAGATACTC | 1757 | 1776 | 12046 | 12065 | 504 |

The modified oligonucleotides in the table below are 5-8-5 MOE gapmers. The gapmers are 20 nucleosides in length and have a central gap segment that consists of eight 2'-β-D-deoxynucleosides, a 5' wing segment that consists of five 2'-β-D-MOE nucleosides, and a 3' wing segment that consists of five 2'-β-D-MOE nucleosides. The sugar motif of the gapmers is (from 5' to 3'): eeeeeddddddddeeee; wherein 'd' represents a 2'-β-D-deoxyribosyl sugar moiety, and 'e' represents a 2'-β-D-MOE sugar moiety. The gapmers have an internucleoside linkage motif of (from 5' to 3'): sooosssssssssooss; wherein each "s" represents a phosphorthioate internucleoside linkage and each "o" represents a phosphodiester internucleoside linkage. Each cytosine nucleobase is a 5-methylcytosine.

TABLE 62

5-8-5 MOE gapmers with a mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166719 | GCAGTATTACCTCTACTA | N/A | N/A | 9536 | 9553 | 2816 |
| 1166720 | GGCAGTATTACCTCTACT | N/A | N/A | 9537 | 9554 | 2817 |
| 1166721 | TGGCAGTATTACCTCTAC | N/A | N/A | 9538 | 9555 | 2818 |
| 1166749 | TCAGCCTGGTTAGCCTTT | N/A | N/A | 9517 | 9534 | 2819 |
| 1166750 | GTCAGCCTGGTTAGCCTT | N/A | N/A | 9518 | 9535 | 2820 |
| 1166751 | AGTCAGCCTGGTTAGCCT | N/A | N/A | 9519 | 9536 | 2821 |
| 1166761 | GTGTATTAGGATCCCATC | N/A | N/A | 11157 | 11174 | 2822 |

TABLE 62-continued 5-8-5 MOE gapmers with a mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166762 | TGTGTATTAGGATCCCAT | N/A | N/A | 11158 | 11175 | 2823 |
| 1166763 | GTGTGTATTAGGATCCCA | N/A | N/A | 11159 | 11176 | 2824 |
| 1166775 | TTATTTTTCCTCAGCGAC | 3045 | 3062 | 13334 | 1335} | 2825 |
| 1166776 | TTTATTTTTCCTCAGCGA | 3046 | 3063 | 13335 | 13352 | 2826 |
| 1166777 | CTTTATTTTTCCTCAGCG | 3047 | 3064 | 13336 | 13353 | 2827 |
| 1166778 | TCTTTATTTTTCCTCAGC | 3048 | 3065 | 13337 | 13354 | 2828 |
| 1166779 | GTCTTTATTTTTCCTCAG | 3049 | 3066 | 13338 | 13355 | 2829 |
| 1166780 | TGTCTTTATTTTTCCTCA | 3050 | 3067 | 13339 | 13356 | 2830 |
| 1166781 | TTGTCTTTATTTTTCCTC | 3051 | 3068 | 13340 | 13357 | 2831 |
| 1166782 | TTTGTCTTTATTTTTCCT | 3052 | 3069 | 13341 | 13358 | 2832 |
| 1166783 | ATTTGTCTTTATTTTTCC | 3053 | 3070 | 13342 | 13359 | 2833 |
| 1166738 | GTGATTTTCCCCGTCTTT | N/A | N/A | 8755 | 8772 | 2835 |
| 1166739 | TGTGATTTTCCCCGTCTT | N/A | N/A | 8756 | 8773 | 2836 |
| 1166740 | GAGATATCTTGTGACCTT | N/A | N/A | 8773 | 8790 | 2837 |
| 1166742 | TTGAGATATCTTGTGACC | N/A | N/A | 8775 | 8792 | 2839 |
| 1166746 | CACATTCACTAATATTTA | N/A | N/A | 9326 | 9343 | 2840 |
| 1166747 | TCACATTCACTAATATTT | N/A | N/A | 9327 | 9344 | 2841 |
| 1166748 | GTCACATTCACTAATATT | N/A | N/A | 9328 | 9345 | 2842 |
| 1166784 | CATTTGTCTTTATTTTTC | 3054 | 3071 | 13343 | 13360 | 2843 |
| 1166785 | GCATTTGTCTTTATTTTT | 3055 | 3072 | 13344 | 13361 | 2844 |
| 1166786 | AGCATTTGTCTTTATTTT | 3056 | 3073 | 13345 | 13362 | 2845 |
| 1166787 | CAGCATTTGTCTTTATTT | 3057 | 3074 | 13346 | 13363 | 2846 |
| 1174012 | TTGTGATTTTCCCCGTCT | N/A | N/A | 8757 | 8774 | 2850 |
| 1174013 | TTTGAGATATCTTGTGAC | N/A | N/A | 8776 | 8793 | 2851 |
| 1174015 | ATTCACTAATATTTAACA | N/A | N/A | 9323 | 9340 | 2852 |
| 1174016 | CATTCACTAATATTTAAC | N/A | N/A | 9324 | 9341 | 2853 |
| 1174018 | CGTCACATTCACTAATAT | N/A | N/A | 9329 | 9346 | 2854 |
| 1174020 | AGCCTGGTTAGCCTTTCT | N/A | N/A | 9515 | 9532 | 2856 |
| 1174024 | AGTATTACCTCTACTAGT | N/A | N/A | 9534 | 9551 | 2859 |
| 1174026 | TTGGCAGTATTACCTCTA | N/A | N/A | 9539 | 9556 | 2861 |
| 1174036 | TATTAGGATCCCATCTAG | N/A | N/A | 11154 | 11171 | 2862 |
| 1174037 | GTATTAGGATCCCATCTA | N/A | N/A | 11155 | 11172 | 2863 |
| 1166744 | GCTTTTGAGATATCTTGT | N/A | N/A | 8779 | 8796 | 2866 |
| 1166757 | CCATTTATCTGTGCTTTA | N/A | N/A | 9579 | 9596 | 2873 |
| 1166758 | TGCCATTTATCTGTGCTT | N/A | N/A | 9581 | 9598 | 2874 |
| 1166759 | CTGCCATTTATCTGTGCT | N/A | N/A | 9582 | 9599 | 2875 |

TABLE 62-continued 5-8-5 MOE gapmers with a mixed PO/PS internucleoside linkages complementary to human GFAP

| Compound No. | SEQUENCE (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1166760 | TCTGCCATTTATCTGTGC | N/A | N/A | 9583 | 9600 | 2876 |
| 1174029 | ACTATCTAGGATTTGGCA | N/A | N/A | 9551 | 9568 | 2886 |
| 1174030 | TGTGACTATCTAGGATTT | N/A | N/A | 9555 | 9572 | 2887 |
| 1174031 | TATCTGTGCTTTAGTGAC | N/A | N/A | 9574 | 9591 | 2888 |
| 1174034 | GCCATTTATCTGTGCTTT | N/A | N/A | 9580 | 9597 | 2891 |

Example 6: Tolerability of Modified Oligonucleotides Complementary to Human GFAP in Wild-Type Mice, 3 Hour Study Modified oligonucleotides described above were tested in wild-type female C57/Bl6 mice to assess the tolerability of the oligonucleotides. Wild-type female C57/Bl6 mice each received a single ICV dose of 700 μg of modified oligonucleotide listed in the table below. Each treatment group consisted of 4 mice. A group of 4 mice received PBS as a negative control for each experiment (identified in separate tables below). At 3 hours post-injection, mice were evaluated according to seven different criteria. The criteria are (1) the mouse was bright, alert, and responsive: (2) the mouse was standing or hunched without stimuli: (3) the mouse showed any movement without stimuli: (4) the mouse demonstrated forward movement after it was lifted; (5) the mouse demonstrated any movement after it was lifted; (6) the mouse responded to tail pinching: (7) regular breathing. For each of the 7 criteria, a mouse was given a subs orc of 0 if it met the criteria and 1 if it did not (the functional observational battery score or FOB). After all 7 criteria were evaluated, the scores were summed for each mouse and averaged within each treatment group. The results are presented in the tables below.

TABLE 63

Tolerability scores in mice at 700 μg dose

| Compound No. | 3 hr. FOB |
|---|---|
| PBS | 0 |
| 1166719 | 1 |
| 1166720 | 0 |
| 1166721 | 0 |
| 1166749 | 3 |
| 1166750 | 1 |
| 1166751 | 2 |
| 1166761 | 4 |
| 1166762 | 4 |
| 1166763 | 3 |
| 1166775 | 0 |
| 1166776 | 1 |
| 1166777 | 4 |
| 1166778 | 1 |
| 1166779 | 4 |
| 1166780 | 1 |
| 1166781 | 0 |
| 1166782 | 0 |
| 1166783 | 0 |
| 1166809 | 4 |

TABLE 63-continued

Tolerability scores in mice at 700 μg dose

| Compound No. | 3 hr. FOB |
|---|---|
| 1166810 | 4 |
| 1166812 | 3 |
| 1166813 | 3 |

TABLE 64

Tolerability scores in mice at 700 μg dose

| Compound No. | 3 hr. FOB |
|---|---|
| PBS | 0 |
| 1166814 | 4 |
| 1166815 | 2 |
| 1166816 | 1 |
| 1166817 | 1 |
| 1166818 | 3 |
| 1166819 | 1 |
| 1166820 | 1 |
| 1166821 | 1 |
| 1166822 | 3 |
| 1166841 | 3 |
| 1166842 | 3 |
| 1166843 | 3 |
| 1166845 | 5 |
| 1166846 | 4 |
| 1166847 | 5 |
| 1166869 | 1 |
| 1166870 | 3 |
| 1166871 | 2 |
| 1166872 | 2 |
| 1166873 | 1 |
| 1166874 | 0 |
| 1166900 | 5 |

TABLE 65

Tolerability scores in mice at 700 μg dose

| Compound No. | 3 hr. FOB |
|---|---|
| PBS | 0 |
| 1166901 | 4 |
| 1166902 | 5 |
| 1166903 | 4 |
| 1166904 | 4 |
| 1166905 | 2 |

TABLE 65-continued

| Tolerability scores in mice at 700 μg dose | |
|---|---|
| Compound No. | 3 hr. FOB |
| 1166906 | 2 |
| 1166907 | 0 |
| 1166909 | 3 |
| 1166910 | 1 |
| 1166911 | 0 |
| 1166912 | 1 |
| 1166913 | 2 |
| 1166932 | 4 |
| 1166933 | 2 |
| 1166934 | 3 |
| 1166991 | 4 |
| 1166992 | 4 |
| 1166993 | 4 |
| 1166994 | 3 |

TABLE 66

| Tolerability scores in mice at 700 μg dose | |
|---|---|
| Compound No. | 3 hr. FOB |
| PBS | 0 |
| 1166996 | 4 |
| 1166997 | 4 |
| 1166998 | 0 |
| 1166999 | 0 |
| 1167000 | 3 |
| 1167001 | 0 |
| 1167002 | 0 |
| 1167003 | 0 |
| 1167004 | 0 |
| 1167024 | 4 |
| 1167025 | 3 |
| 1167026 | 4 |
| 1167027 | 4 |
| 1167050 | 1 |
| 1167051 | 0 |
| 1167053 | 1 |
| 1167054 | 4 |
| 1167055 | 0 |
| 1167056 | 0 |

TABLE 67

| Tolerability scores in mice at 700 μg dose | |
|---|---|
| Compound No. | 3 hr. FOB |
| PBS | 0 |
| 1166738 | 0 |
| 1166739 | 0 |
| 1166740 | 4 |
| 1166742 | 3 |
| 1166746 | 0 |
| 1166747 | 0 |
| 1166748 | 0 |
| 1166784 | 0 |
| 1166785 | 1 |
| 1166786 | 3 |
| 1166787 | 3 |
| 1166793 | 0 |
| 1166794 | 0 |
| 1166795 | 1 |
| 1166797 | 4 |
| 1166798 | 3 |

TABLE 68

| Tolerability scores in mice at 700 μg dose | |
|---|---|
| Compound No. | 3 hr. FOB |
| PBS | 0 |
| 1166799 | 1 |
| 1166802 | 0 |
| 1166803 | 0 |
| 1166804 | 0 |
| 1166805 | 0 |
| 1166806 | 0 |
| 1166807 | 0 |
| 1166808 | 0 |
| 1166867 | 0 |
| 1166877 | 1 |
| 1166878 | 2 |
| 1166885 | 3 |
| 1166886 | 0 |
| 1166887 | 3 |
| 1166888 | 3 |
| 1166890 | 0 |
| 1166893 | 0 |

TABLE 69

| Tolerability scores in mice at 700 μg dose | |
|---|---|
| Compound No. | 3 hr. FOB |
| PBS | 0 |
| 1166894 | 0 |
| 1166895 | 0 |
| 1166896 | 0 |
| 1166897 | 0 |
| 1166898 | 0 |
| 1166899 | 0 |
| 1166984 | 0 |
| 1166985 | 0 |
| 1166986 | 0 |
| 1166987 | 0 |
| 1166988 | 0 |
| 1166990 | 0 |

TABLE 70

| Tolerability scores in mice at 700 μg dose | |
|---|---|
| Compound No. | 3 hr. FOB |
| PBS | 0 |
| 1167057 | 0 |
| 1167059 | 1 |
| 1167060 | 1 |
| 1174012 | 2 |
| 1174013 | 3 |
| 1174015 | 0 |
| 1174016 | 0 |
| 1174018 | 0 |
| 1174020 | 4 |
| 1174024 | 3 |
| 1174026 | 0 |
| 1174036 | 3 |
| 1174037 | 2 |

TABLE 71

| Tolerability scores in mice at 700 µg dose | |
|---|---|
| Compound No. | 3 hr. FOB |
| PBS | 0 |
| 1166744 | 3 |
| 1166757 | 4 |
| 1166758 | 3 |
| 1166759 | 1 |
| 1166760 | 3 |
| 1166800 | 1 |
| 1166823 | 2 |
| 1166826 | 3 |
| 1166831 | 2 |
| 1166875 | 0 |
| 1166975 | 4 |
| 1166989 | 0 |

TABLE 72

| Tolerability scores in mice at 700 µg dose | |
|---|---|
| Compound No. | 3 hr. FOB |
| PBS | 0 |
| 1166835 | 0 |
| 1166916 | 3 |
| 1166920 | 2 |
| 1166926 | 1 |
| 1166927 | 2 |
| 1166928 | 1 |
| 1166929 | 0 |
| 1166982 | 2 |

TABLE 73

| Tolerability scores in mice at 700 µg dose | |
|---|---|
| Compound No. | 3 hr. FOB |
| PBS | 0 |
| 1167007 | 2 |
| 1167011 | 1 |
| 1167012 | 3 |
| 1167017 | 2 |
| 1167018 | 1 |
| 1174029 | 4 |

TABLE 74

| Tolerability scores in mice at 700 µg dose | |
|---|---|
| Compound No. | 3 hr. FOB |
| PBS | 0 |
| 1174030 | 3 |
| 1174031 | 3 |
| 1174034 | 1 |
| 1174050 | 3 |
| 1174051 | 3 |
| 1174053 | 1 |
| 1174054 | 1 |
| 1174056 | 4 |
| 1174058 | 3 |
| 1174059 | 0 |
| 1174060 | 0 |
| 1174061 | 2 |
| 1174062 | 3 |
| 1174063 | 3 |

TABLE 74-continued

| Tolerability scores in mice at 700 µg dose | |
|---|---|
| Compound No. | 3 hr. FOB |
| 1174065 | 1 |
| 1174066 | 1 |

TABLE 75

| Tolerability scores in mice at 700 µg dose | |
|---|---|
| Compound No. | 3 hr. FOB |
| PBS | 0 |
| 1166852 | 1 |

TABLE 76

| Tolerability scores in mice at 700 µg dose | |
|---|---|
| Compound No. | 3 hr. FOB |
| PBS | 0 |
| 1166940 | 2 |
| 1166946 | 2 |
| 1166948 | 2 |

TABLE 77

| Tolerability scores in mice at 700 µg dose | |
|---|---|
| Compound No. | 3 hr. FOB |
| PBS | 0 |
| 1166954 | 0 |
| 1167033 | 0 |
| 1167034 | 1 |
| 1167035 | 1 |
| 1167036 | 2 |
| 1167037 | 2 |
| 1167040 | 2 |

TABLE 78

| Tolerability scores in mice at 700 µg dose | |
|---|---|
| Compound No. | 3 hr. FOB |
| PBS | 0 |
| 1167046 | 3 |
| 1167058 | 1 |

TABLE 79

| Tolerability scores in mice at 700 µg dose | |
|---|---|
| Compound No. | 3 hr. FOB |
| PBS | 0 |
| 1199982 | 1 |

TABLE 79-continued

| Tolerability scores in mice at 700 μg dose | |
|---|---|
| Compound No. | 3 hr. FOB |
| 1199983 | 1 |
| 1199984 | 1 |

Example 7: Activity of Modified Oligonucleotides Complementary to Human GFAP in Transgenic Mice Modified oligonucleotides described above were tested in human GFAP transgenic mouse model. Transgenic mice (line 73.7) was previously described in Messing A., et al., Fatal encephalopathy with astrocyte inclusions in GFAP transgenic mice, Am J Pathos, 1998, 152(2):391-398.

Treatment

The GFAP transgenic mice were divided into groups of 34 mice each. Each mouse received a single ICV bolus of 300 μg of modified oligonucleotide. A group of 34 mice received PBS as a negative control.

RNA Analysis

One week post treatment, mice were sacrificed and RNA was extracted from cortical brain tissue, and/or spinal cord for RTPCR analysis to measure amount of GFAP RNA using primer probe set RTS38621 ((forward sequence AGTTGCAGTCCTTGACCTG, designated herein as SEQ ID NO: 14; reverse sequence CAGCGCCTCCTGA-TAACTG, designated herein as SEQ ID NO: 15; probe sequence ACGAGTCCCTGGAGAGGCAGATG, designated herein as SEQ ID NO: 16), which is a human specific primer-probe set that recognizes all isoforms of GFAP. Results are presented as percent human GFAP RNA relative to PBS control, normalized to mouse peptidylprolyl isomerase A (PPIA), also known as cyclophilin A. Mouse PPIA was amplified using primer probe set m_cyclo24 (forward sequence TCGCCGCTTGCTGCA, designated herein as SEQ ID NO: 17; reverse sequence ATCGGCCGT-GATGTCGA, designated herein as SEQ ID NO: 18; probe sequence CCATGGTCAACCCCACCGTGTTC, designated herein as SEQ ID NO: 19). In some cases, RTPCR value is not defined for a certain sample, and is labeled N.D. (Not Defined).

As shown in the table below, treatment with modified oligonucleotides resulted in reduction of GFAP RNA in comparison to the PBS control.

TABLE 80

| Reduction of human GFAP RNA in transgenic mice | | |
|---|---|---|
| | GFAP RNA (% control) | |
| Compound No. | SPINAL CORD | CORTEX |
| PBS | 100 | 100 |
| 1047198 | 44 | 44 |
| 1047362 | 15 | 21 |
| 1047373 | 10 | 16 |
| 1047374 | 8 | 16 |
| 1047386 | 14 | 19 |
| 1047394 | 48 | 43 |
| 1047429 | N.D. | N.D. |
| 1047448 | 37 | 45 |
| 1047500 | 23 | 26 |
| 1047580 | 12 | 15 |
| 1047582 | 5 | 8 |

TABLE 80-continued

| Reduction of human GFAP RNA in transgenic mice | | |
|---|---|---|
| | GFAP RNA (% control) | |
| Compound No. | SPINAL CORD | CORTEX |
| 1047583 | 6 | 9 |
| 1047584 | 6 | 7 |
| 1047585 | 8 | 7 |
| 1047586 | 12 | 11 |
| 1047587 | 13 | 13 |
| 1047589 | 9 | 13 |
| 1047590 | 16 | 16 |
| 1047591 | 14 | 17 |
| 1047610 | 33 | 31 |
| 1048203 | 26 | 27 |
| 1048350 | 28 | 24 |

TABLE 81

| Reduction of human GFAP RNA in transgenic mice | | |
|---|---|---|
| | GFAP RNA (% control) | |
| Compound No. | SPINAL CORD | CORTEX |
| PBS | 100 | 100 |
| 1047211 | 71 | 66 |
| 1047225 | 65 | 61 |
| 1047298 | 34 | 27 |
| 1047316 | 29 | 24 |
| 1047402 | 30 | 25 |
| 1047432 | 28 | 29 |
| 1047518 | 49 | 34 |
| 1047522 | 23 | 19 |
| 1047532 | 40 | 30 |
| 1047579 | 27 | 17 |
| 1047581 | 11 | 10 |
| 1047598 | 77 | 50 |
| 1047599 | 21 | 15 |
| 1047601 | 47 | 30 |
| 1047602 | N.D. | N.D. |
| 1047609 | 27 | 18 |
| 1047662 | 34 | 27 |
| 1047679 | 58 | 54 |

TABLE 82

| Reduction of human GFAP RNA in transgenic mice | | |
|---|---|---|
| | GFAP RNA (% control) | |
| Compound No. | SPINAL CORD | CORTEX |
| PBS | 100 | 100 |
| 1047711 | 45 | 38 |
| 1047884 | 57 | 62 |
| 1047913 | 75 | 66 |
| 1048027 | 64 | 53 |
| 1048151 | 69 | 64 |
| 1048182 | 14 | 10 |
| 1048201 | 6 | 7 |
| 1048204 | 21 | 18 |
| 1048227 | 42 | 28 |
| 1072855 | N.D. | N.D. |
| 1072856 | N.D. | N.D. |
| 1072857 | 28 | 14 |
| 1072861 | 28 | 23 |
| 1072862 | 53 | 33 |
| 1072863 | 51 | 28 |
| 1072886 | 42 | 26 |
| 1072980 | 40 | 25 |
| 1072986 | 98 | 88 |
| 1073033 | 100 | 80 |
| 1073045 | 36 | 24 |

TABLE 82-continued

| Reduction of human GFAP RNA in transgenic mice | | |
|---|---|---|
| | GFAP RNA (% control) | |
| Compound No. | SPINAL CORD | CORTEX |
| 1073060 | 19 | 16 |
| 1073063 | 19 | 15 |
| 1073064 | 29 | 20 |
| 1073065 | 16 | 15 |
| 1073093 | 11 | 8 |

TABLE 83

| Reduction of human GFAP RNA in transgenic mice | | |
|---|---|---|
| | GFAP RNA (% control) | |
| Compound No. | SPINAL CORD | CORTEX |
| PBS | 100 | 100 |
| 1103217 | 56 | 43 |
| 1103465 | 31 | 19 |
| 1103502 | 47 | 31 |
| 1103516 | 42 | 27 |
| 1103567 | 23 | 18 |
| 1104093 | 13 | 12 |
| 1104118 | N.D. | N.D. |
| 1104145 | 8 | 6 |
| 1104152 | 27 | 17 |
| 1104166 | 17 | 13 |
| 1104175 | 15 | 8 |

TABLE 84

| Reduction of human GFAP RNA in transgenic mice | | |
|---|---|---|
| | GFAP RNA (% control) | |
| Compound No. | SPINAL CORD | CORTEX |
| PBS | 100 | 100 |
| 1072813 | 15 | 18 |
| 1072814 | 15 | 19 |
| 1103202 | 34 | 36 |
| 1103218 | 48 | 33 |
| 1103253 | 56 | 36 |
| 1103255 | N.D. | N.D. |
| 1103256 | 35 | 41 |
| 1103257 | 46 | 43 |
| 1103258 | N.D. | N.D. |
| 1103259 | 82 | 71 |
| 1103268 | N.D. | N.D. |
| 1104307 | 13 | 14 |
| 1104309 | 10 | 11 |
| 1104311 | 11 | 18 |
| 1104349 | N.D. | N.D. |

TABLE 85

| Reduction of human GFAP RNA in transgenic mice | | |
|---|---|---|
| | GFAP RNA (% control) | |
| Compound No. | SPINAL CORD | CORTEX |
| PBS | 100 | 100 |
| 1103279 | 20 | 14 |
| 1103285 | 16 | 9 |
| 1103411 | 65 | 32 |
| 1103471 | 32 | 39 |
| 1103570 | 6 | 4 |
| 1103872 | 42 | 18 |
| 1104116 | 6 | 3 |
| 1104127 | 15 | 10 |
| 1104144 | 17 | 8 |
| 1104159 | 17 | 10 |
| 1104276 | 53 | 41 |
| 1166719 | 41 | 31 |
| 1166720 | 12 | 8 |
| 1166721 | 7 | 8 |
| 1166749 | 13 | 11 |
| 1166750 | 10 | 7 |
| 1166751 | 12 | 9 |
| 1166761 | 12 | 5 |

TABLE 86

| Reduction of human GFAP RNA in transgenic mice | |
|---|---|
| Compound No. | GFAP RNA (% control) CORTEX |
| PBS | 100 |
| 1166762 | 18 |
| 1166763 | 13 |
| 1166775 | 21 |
| 1166776 | 30 |
| 1166777 | 13 |
| 1166778 | 6 |
| 1166779 | 7 |
| 1166780 | 9 |
| 1166781 | 7 |
| 1166782 | 12 |
| 1166783 | 17 |
| 1166809 | 13 |
| 1166810 | 16 |
| 1166812 | 23 |
| 1166813 | 21 |
| 1166814 | 29 |
| 1166815 | 42 |
| 1166816 | 31 |
| 1166817 | 37 |
| 1166818 | 14 |
| 1166819 | 9 |
| 1166820 | 12 |
| 1166821 | 15 |
| 1166822 | 20 |
| 1166841 | 47 |

TABLE 87

| Reduction of human GFAP RNA in transgenic mice | | |
|---|---|---|
| | GFAP RNA (% control) | |
| Compound No. | SPINAL CORD | CORTEX |
| PBS | 100 | 100 |
| 1166842 | 19 | 14 |
| 1166843 | 37 | 21 |
| 1166845 | 17 | 19 |
| 1166846 | 12 | 18 |
| 1166847 | 13 | 19 |
| 1166869 | 10 | 11 |
| 1166870 | 6 | 7 |
| 1166871 | 5 | 7 |
| 1166872 | 10 | 9 |
| 1166873 | 14 | 14 |
| 1166874 | 9 | 10 |
| 1166900 | 14 | 20 |

TABLE 87-continued

| Reduction of human GFAP RNA in transgenic mice | | |
|---|---|---|
| | GFAP RNA (% control) | |
| Compound No. | SPINAL CORD | CORTEX |
| 1166901 | 11 | 13 |
| 1166902 | 12 | 15 |
| 1166903 | 17 | 19 |
| 1166904 | 26 | 30 |
| 1166905 | 24 | 28 |
| 1166906 | 50 | 56 |
| 1166907 | 28 | 32 |

TABLE 88

| Reduction of human GFAP RNA in transgenic mice | |
|---|---|
| Compound No. | GFAP RNA (% control) CORTEX |
| PBS | 100 |
| 1166909 | 30 |
| 1166910 | 8 |
| 1166911 | 7 |
| 1166912 | 15 |
| 1166913 | 12 |
| 1166932 | 41 |
| 1166933 | 13 |
| 1166934 | 18 |
| 1166991 | 14 |
| 1166992 | 11 |
| 1166993 | 9 |
| 1166994 | 10 |
| 1166996 | 21 |
| 1166997 | 30 |
| 1166998 | 13 |
| 1166999 | 11 |
| 1167000 | 15 |

TABLE 89

| Reduction of human GFAP RNA in transgenic mice | |
|---|---|
| Compound No. | GFAP RNA (% control) CORTEX |
| PBS | 100 |
| 1167001 | 9 |
| 1167002 | 7 |
| 1167003 | 8 |
| 1167004 | 13 |
| 1167024 | 18 |
| 1167025 | 11 |
| 1167026 | 14 |
| 1167027 | 13 |
| 1167050 | 11 |
| 1167051 | 10 |
| 1167053 | 7 |
| 1167054 | 5 |
| 1167055 | 6 |
| 1167056 | 6 |

TABLE 90

| Reduction of human GFAP RNA in transgenic mice | |
|---|---|
| Compound No. | GFAP RNA (% control) CORTEX |
| PBS | 100 |
| 1166738 | 27 |
| 1166739 | 27 |
| 1166740 | 26 |
| 1166742 | 43 |
| 1166746 | 94 |
| 1166747 | 23 |
| 1166748 | 20 |
| 1166784 | 30 |
| 1166785 | 13 |
| 1166786 | 19 |
| 1166787 | 19 |
| 1166793 | 23 |
| 1166794 | 32 |
| 1166795 | 51 |
| 1166798 | 25 |
| 1166799 | 33 |
| 1166802 | 38 |
| 1166803 | 31 |
| 1166804 | 29 |
| 1166805 | 7 |
| 1166806 | 23 |
| 1166807 | 19 |
| 1166808 | 14 |
| 1166867 | 13 |
| 1166877 | 7 |
| 1166878 | 13 |
| 1166885 | 20 |
| 1166886 | 25 |

TABLE 91

| Reduction of human GFAP RNA in transgenic mice | |
|---|---|
| Compound No. | GFAP RNA (% control) CORTEX |
| PBS | 100 |
| 1166887 | 12 |
| 1166888 | 16 |
| 1166890 | 38 |
| 1166893 | 39 |
| 1166894 | 20 |
| 1166895 | 11 |
| 1166896 | 8 |
| 1166897 | 6 |
| 1166898 | 8 |
| 1166899 | 11 |
| 1166984 | 24 |
| 1166985 | 9 |
| 1166986 | 13 |
| 1166987 | 7 |
| 1166988 | 5 |
| 1166990 | 9 |
| 1167057 | 7 |
| 1167059 | 5 |
| 1167060 | 8 |
| 1174012 | 9 |
| 1174013 | 33 |
| 1174015 | 107 |

TABLE 92

| Reduction of human GFAP RNA in transgenic mice | |
|---|---|
| Compound No. | GFAP RNA (% control) CORTEX |
| PBS | 100 |
| 1166744 | 14 |
| 1166757 | 7 |
| 1166758 | 34 |
| 1166759 | 9 |
| 1166760 | 16 |
| 1166800 | 8 |
| 1166823 | 7 |
| 1166826 | 6 |
| 1166831 | 16 |
| 1166835 | 47 |
| 1166875 | 7 |
| 1166916 | 14 |
| 1166920 | 18 |
| 1166975 | 6 |
| 1166989 | 4 |
| 1174016 | 66 |
| 1174018 | 11 |
| 1174020 | 12 |
| 1174024 | 52 |
| 1174026 | 7 |
| 1174036 | 43 |
| 1174037 | 24 |

TABLE 93

| Reduction of human GFAP RNA in transgenic mice | |
|---|---|
| Compound No. | GFAP RNA (% control) CORTEX |
| PBS | 100 |
| 1166926 | 14 |
| 1166927 | 15 |
| 1166928 | 13 |
| 1166929 | 15 |
| 1166982 | 11 |
| 1167007 | 44 |
| 1167011 | 21 |
| 1167012 | 23 |
| 1167017 | 8 |
| 1167018 | 11 |
| 1174029 | 32 |
| 1174030 | 75 |
| 1174031 | 35 |
| 1174034 | 17 |
| 1174050 | 10 |
| 1174051 | 15 |
| 1174053 | 22 |
| 1174054 | 40 |
| 1174056 | 7 |
| 1174058 | 14 |
| 1174059 | 14 |
| 1174060 | 19 |
| 1174061 | 17 |
| 1174062 | 12 |
| 1174063 | 12 |

TABLE 94

| Reduction of human GFAP RNA in transgenic mice | |
|---|---|
| Compound No. | GFAP RNA (% control) CORTEX |
| PBS | 100 |
| 1166852 | 15 |
| 1166940 | 16 |
| 1166946 | 34 |
| 1166948 | 41 |
| 1166954 | 16 |
| 1167033 | 9 |
| 1167034 | 11 |
| 1167035 | 15 |
| 1167036 | 19 |
| 1167037 | 25 |
| 1167040 | 15 |

TABLE 95

| Reduction of human GFAP RNA in transgenic mice | |
|---|---|
| Compound No. | GFAP RNA (% control) CORTEX |
| PBS | 100 |
| 1167046 | 14 |
| 1167058 | 5 |
| 1174065 | 10 |
| 1174066 | 13 |
| 1199982 | 4 |
| 1199983 | 13 |
| 1199984 | 16 |

Example 8: Tolerability of Modified Oligonucleotides Complementary to Human GFAP in Rats, 3 mg Dose Modified oligonucleotides described above were tested in rats to assess the tolerability of the oligonucleotides. Sprague Dawley rats each received a single intrathecal (IT) dose of 3 mg of oligonucleotide listed in the table below. Each treatment group consisted of 24 rats. A group of 24 rats received PBS as a negative control. At 3 hours post-injection, movement in 7 different parts of the body were evaluated for each rat. The 7 body parts are (1) the rat's tail: (2) the rat's posterior posture; (3) the rat's hind limbs: (4) the rat's hind paws: (5) the rat's forepaws: (6) the rat's anterior posture; (7) the rat's head. For each of the 7 different body parts, each rat was given a sub-score of 0 if the body part was moving or 1 if the body part was paralyzed (the functional observational battery score or FOB). After each of the 7 body parts were evaluated, the sub-scores were summed for each rat and then averaged for each group. For example, if a rat's tail, head, and all other evaluated body parts were moving 3 hours after the 3 mg IT dose, it would get a summed score of 0. If another rat was not moving its tail 3 hours after the 3 mg IT dose but all other evaluated body parts were moving, it would receive a score of 1. Results are presented as the average score for each treatment group.

TABLE 96

| Tolerability scores in rats at 3 mg dose | |
|---|---|
| Compound No. | FOB 3 hr |
| PBS | 0 |
| 1047198 | 4 |
| 1047362 | 3 |
| 1047386 | 5 |
| 1047580 | 2 |
| 1047583 | 1 |
| 1047584 | 2 |
| 1047585 | 0 |
| 1047586 | 0 |
| 1047587 | 0 |
| 1047589 | 2 |
| 1047590 | 2 |
| 1047591 | 4 |
| 1048350 | 3 |

TABLE 97

| Tolerability scores in rats at 3 mg dose | |
|---|---|
| Compound No. | FOB 3 hr |
| PBS | 0 |
| 1047429 | 2 |
| 1047448 | 1 |
| 1047500 | 3 |
| 1047581 | 2 |
| 1047599 | 2 |
| 1047609 | 5 |
| 1047913 | 4 |
| 1048027 | 3 |
| 1048151 | 2 |

TABLE 98

| Tolerability scores in rats at 3 mg dose | |
|---|---|
| Compound No. | FOB 3 hr |
| PBS | 0 |
| 1047316 | 4 |
| 1047402 | 3 |
| 1047522 | 0 |
| 1047532 | 3 |
| 1047579 | 4 |
| 1048201 | 2 |
| 1048204 | 0 |

TABLE 99

| Tolerability scores in rats at 3 mg dose | |
|---|---|
| Compound No. | FOB 3 hr |
| PBS | 0 |
| 1047298 | 3 |
| 1072813 | 0 |
| 1072814 | 4 |
| 1072855 | 4 |
| 1072857 | 4 |
| 1104116 | 0 |
| 1104145 | 2 |
| 1104175 | 4 |
| 1166721 | 0 |
| 1166750 | 4 |
| 1166751 | 4 |
| 1166871 | 2 |

TABLE 100

| Tolerability scores in rats at 3 mg dose | |
|---|---|
| Compound No. | FOB 3 hr |
| PBS | 0 |
| 1166720 | 1 |
| 1166775 | 2 |
| 1166778 | 2 |
| 1166780 | 2 |
| 1166781 | 1 |
| 1166782 | 1 |
| 1166783 | 1 |
| 1166819 | 2 |
| 1166820 | 3 |
| 1166821 | 3 |
| 1166842 | 4 |
| 1166869 | 2 |
| 1166872 | 2 |
| 1166873 | 0 |
| 1166874 | 0 |

TABLE 101

| Tolerability scores in rats at 3 mg dose | |
|---|---|
| Compound No. | FOB 3 hr |
| PBS | 0 |
| 1166748 | 0 |
| 1166785 | 2 |
| 1166793 | 1 |
| 1166805 | 1 |
| 1166806 | 2 |
| 1166807 | 0 |
| 1166910 | 3 |
| 1166911 | 2 |
| 1166912 | 3 |
| 1166933 | 3 |
| 1166998 | 2 |
| 1167050 | 4 |
| 1167053 | 3 |
| 1167055 | 2 |
| 1167056 | 1 |

TABLE 102

| Tolerability scores in rats at 3 mg dose | |
|---|---|
| Compound No. | FOB 3 hr |
| PBS | 0 |
| 1166808 | 0 |
| 1166867 | 1 |

TABLE 102-continued

| Tolerability scores in rats at 3 mg dose | |
|---|---|
| Compound No. | FOB 3 hr |
| 1166877 | 2 |
| 1166878 | 3 |
| 1166894 | 1 |
| 1166895 | 0 |
| 1166896 | 2 |
| 1166897 | 2 |
| 1166898 | 0 |
| 1166899 | 0 |
| 1166985 | 0 |
| 1166990 | 0 |

TABLE 103

| Tolerability scores in rats at 3 mg dose | |
|---|---|
| Compound No. | FOB 3 hr |
| PBS | 0 |
| 1166759 | 2 |
| 1166760 | 2 |
| 1166800 | 3 |
| 1166823 | 4 |
| 1166831 | 5 |
| 1166875 | 1 |
| 1166920 | 3 |
| 1166926 | 2 |
| 1166927 | 2 |
| 1166928 | 2 |
| 1166982 | 3 |
| 1166986 | 1 |
| 1166987 | 1 |
| 1166988 | 5 |
| 1166989 | 1 |
| 1167001 | 3 |

TABLE 104

| Tolerability scores in rats at 3 mg dose | |
|---|---|
| Compound No. | FOB 3 hr |
| PBS | 0 |
| 1167002 | 2 |
| 1167003 | 3 |
| 1167017 | 3 |
| 1167018 | 3 |
| 1167057 | 1 |
| 1167059 | 2 |
| 1167060 | 2 |
| 1174012 | 3 |
| 1174018 | 3 |
| 1174026 | 2 |
| 1174034 | 3 |
| 1174059 | 1 |
| 1174060 | 1 |
| 1174061 | 4 |

TABLE 105

| Tolerability scores in rats at 3 mg dose | |
|---|---|
| Compound No. | FOB 3 hr |
| PBS | 0 |
| 1166852 | 3 |
| 1166940 | 2 |
| 1166946 | 2 |
| 1166948 | 3 |
| 1166954 | 2 |

TABLE 106

| Tolerability scores in rats at 3 mg dose | |
|---|---|
| Compound No. | FOB 3 hr |
| PBS | 0 |
| 1167033 | 4 |
| 1167034 | 3 |
| 1167035 | 3 |
| 1167036 | 2 |
| 1167037 | 2 |
| 1167040 | 3 |
| 1167046 | 3 |
| 1167058 | 2 |

TABLE 107

| Tolerability scores in rats at 3 mg dose | |
|---|---|
| Compound No. | FOB 3 hr |
| PBS | 0 |
| 1174065 | 1 |
| 1174066 | 2 |
| 1199982 | 1 |
| 1199983 | 1 |
| 1199984 | 2 |

Example 9: Potency of Modified Oligonucleotides Complementary to Human GFAP in Transgenic Mice Modified oligonucleotides described above were tested in human GFAP transgenic mouse model. Transgenic mice (line 73.7) was previously described in Messing A., et al., Fatal encephalopathy with astrocyte inclusions in GFAP transgenic mice, Am J Pathos, 1998, 152(2):391-398.

Treatment

The GFAP transgenic mice were divided into groups of 4 mice each. Each mouse received a single ICV bolus of modified oligonucleotide at the doses indicated in tables below. A group of 4-8 mice received PBS as a negative control.

RNA Analysis

Two weeks post treatment, mice were sacrificed, and RNA was extracted from the cortex, spinal cord, and brainstem for RTPCR analysis of RNA expression of GFAP using primer probe set RTS38621, described in Example 6 above. Results are presented as percent change of RNA, relative to PBS control, normalized to mouse PPIA. The half maximal effective dose ($ED_{50}$) of each modified oligonucleotide was calculated using GraphPad Prism 6 software (GraphPad Software, San Diego. CA). $ED_{50}$ values were calculated from dose and individual animal GFAP mRNA levels using custom equation Motulsky: Agonist vs response—Variable slope (four parameters) Y=Bottom+(Top−Bottom)/(1+(10^log EC50/X)^HillSlope), with the following constraints: bottom>lowest value in data set in order to compare across ASOs (3, 5, and 3 for cortex, spinal cord, and brainstem, respectively), top=100, HillSlope<−1 and >−2.

As shown in the table below, treatment with modified oligonucleotides resulted in dose-responsive reduction of GFAP RNA in comparison to the PBS control.

TABLE 108

Reduction of human GFAP RNA (all isoforms) in transgenic mice

| Compound No. | Dose (μg) | GFAP RNA (% control) CORTEX | $ED_{50}$ (μg) |
|---|---|---|---|
| PBS | N/A | 100 | N/A |
| 1104145 | 1 | 77 | 8 |
| | 3 | 74 | |
| | 10 | 53 | |
| | 30 | 19 | |
| | 100 | 8 | |

TABLE 109

Reduction of human GFAP RNA (all isoforms) in transgenic mice

| | | GFAP RNA (% control) | | | $ED_{50}$ (μg) | | |
|---|---|---|---|---|---|---|---|
| Compound No. | Dose (μg) | CORTEX | SPINAL CORD | BRAIN STEM | CORTEX | SPINAL CORD | BRAIN STEM |
| PBS | N/A | 100 | 100 | 100 | N/A | N/A | N/A |
| 1072813 | 3 | 93 | 101 | 99 | 34 | 24 | 21 |
| | 10 | 68 | 71 | 69 | | | |
| | 30 | 70 | 38 | 37 | | | |
| | 100 | 18 | 28 | 21 | | | |
| | 300 | 10 | 19 | 13 | | | |
| 1166721 | 1 | 116 | 111 | 94 | 25 | 25 | 12 |
| | 3 | 95 | 104 | 89 | | | |
| | 10 | 91 | 73 | 51 | | | |
| | 30 | 39 | 47 | 28 | | | |
| | 100 | 13 | 18 | 11 | | | |
| | 300 | 7 | 10 | 6 | | | |
| 1166874 | 1 | 81 | 102 | 78 | 27 | 11 | 7 |
| | 3 | 73 | 83 | 75 | | | |
| | 10 | 77 | 50 | 45 | | | |
| | 30 | 65 | 32 | 22 | | | |
| | 100 | 12 | 14 | 10 | | | |
| | 300 | 5 | 9 | 6 | | | |
| 1166895 | 3 | 108 | 93 | 93 | 41 | 93 | 38 |
| | 10 | 82 | 94 | 80 | | | |
| | 30 | 46 | 74 | 50 | | | |
| | 100 | 40 | 40 | 32 | | | |

TABLE 110

Reduction of human GFAP RNA (all isoforms) in transgenic mice

| | | GFAP RNA (% control) | | | ED50 (μg) | | |
|---|---|---|---|---|---|---|---|
| Compound No. | Dose (μg) | CORTEX | SPINAL CORD | BRAIN STEM | CORTEX | SPINAL CORD | BRAIN STEM |
| PBS | N/A | 100 | 100 | 100 | N/A | N/A | N/A |
| 1166895 | 300 | 16 | 45 | 27 | N/A | N/A | N/A |
| 1166926 | 3 | 103 | 77 | 77 | 47 | 32 | 17 |
| | 10 | 86 | 70 | 57 | | | |
| | 30 | 67 | 62 | 49 | | | |
| | 100 | 27 | 27 | 20 | | | |
| | 300 | 13 | 21 | 11 | | | |

TABLE 110-continued

Reduction of human GFAP RNA (all isoforms) in transgenic mice

| Compound No. | Dose (μg) | GFAP RNA (% control) CORTEX | GFAP RNA (% control) SPINAL CORD | GFAP RNA (% control) BRAIN STEM | ED50 (μg) CORTEX | ED50 (μg) SPINAL CORD | ED50 (μg) BRAIN STEM |
|---|---|---|---|---|---|---|---|
| 1166985 | 1 | 105 | 101 | 100 | 46 | 36 | 14 |
| | 3 | 96 | 90 | 78 | | | |
| | 10 | 75 | 68 | 53 | | | |
| | 30 | 79 | 58 | 40 | | | |
| | 100 | 17 | 35 | 15 | | | |
| | 300 | 8 | 23 | 10 | | | |
| 1167056 | 1 | 102 | 87 | 86 | 10 | 5 | 3 |
| | 3 | 81 | 60 | 42 | | | |
| | 10 | 54 | 35 | 20 | | | |
| | 30 | 20 | 16 | 9 | | | |
| | 100 | 5 | 8 | 5 | | | |
| | 300 | 3 | 7 | 4 | | | |
| 1167058 | 1 | 98 | 82 | 80 | 19 | 4 | 3 |
| | 3 | 79 | 59 | 44 | | | |
| | 10 | 79 | 21 | 20 | | | |

TABLE 111

Reduction of human GFAP RNA (all isoforms) in transgenic mice

| Compound No. | Dose (μg) | GFAP RNA (% control) CORTEX | GFAP RNA (% control) SPINAL CORD | GFAP RNA (% control) BRAIN STEM | ED50 (μg) CORTEX | ED50 (μg) SPINAL CORD | ED50 (μg) BRAIN STEM |
|---|---|---|---|---|---|---|---|
| PBS | N/A | 100 | 100 | 100 | N/A | N/A | N/A |
| 1166927 | 3 | 91 | 92 | 89 | 44 | 24 | 15 |
| | 10 | 98 | 62 | 57 | | | |
| | 30 | 62 | 52 | 35 | | | |
| | 100 | 25 | 26 | 14 | | | |
| | 300 | 14 | 20 | 12 | | | |
| 1166954 | 3 | 106 | 87 | 85 | 58 | 60 | 26 |
| | 10 | 79 | 80 | 68 | | | |
| | 30 | 70 | 65 | 49 | | | |
| | 100 | 36 | 46 | 27 | | | |
| | 300 | 20 | 25 | 17 | | | |
| 1166986 | 3 | 114 | 113 | 101 | 35 | 42 | 21 |
| | 10 | 87 | 88 | 66 | | | |
| | 30 | 52 | 56 | 38 | | | |
| | 100 | 23 | 30 | 20 | | | |
| | 300 | 10 | 20 | 14 | | | |
| 1166998 | 3 | 77 | 73 | 61 | 23 | 13 | 6 |
| | 10 | 90 | 63 | 42 | | | |
| | 30 | 36 | 31 | 20 | | | |
| 1167058 | 30 | 34 | 14 | 9 | N/A | N/A | N/A |
| | 100 | 9 | 7 | 6 | | | |
| | 300 | 5 | 6 | 4 | | | |

TABLE 112

Reduction of human GFAP RNA (all isoforms) in transgenic mice

| Compound No. | Dose (μg) | GFAP RNA (% control) RTS38621 CORTEX | GFAP RNA (% control) RTS38621 SPINAL CORD | GFAP RNA (% control) RTS38621 BRAIN STEM | ED50 (μg) CORTEX | ED50 (μg) SPINAL CORD | ED50 (μg) BRAIN STEM |
|---|---|---|---|---|---|---|---|
| PBS | | 100 | 100 | 100 | N/A | N/A | N/A |
| 1166998 | 100 | 11 | 18 | 17 | N/A | N/A | N/A |
| | 300 | 7 | 12 | 9 | N/A | N/A | N/A |

TABLE 112-continued

Reduction of human GFAP RNA (all isoforms) in transgenic mice

| Compound No. | Dose (μg) | GFAP RNA (% control) RTS38621 CORTEX | SPINAL CORD | BRAIN STEM | ED50 (μg) CORTEX | SPINAL CORD | BRAIN STEM |
|---|---|---|---|---|---|---|---|
| 1199983 | 3 | 75 | 83 | 71 | | | |
| | 10 | 72 | 57 | 62 | 18 | | 15 |
| | 30 | 37 | 38 | 38 | | 16 | |
| | 100 | 17 | 27 | 22 | | | |
| | 300 | 12 | 22 | 17 | | | |

Example 10: Effect of Modified Oligonucleotides on Human GFAP RNA In Vitro, Multiple Doses Modified oligonucleotides selected from the examples above were tested at various doses in U251 cells. Cultured U251 cells at a density of 30,000 cells per well were treated with electroporation with various concentrations of modified oligonucleotide as specified in the tables below. After a treatment period of approximately 24 hours, total RNA was isolated from the cells and GFAP RNA levels were measured by quantitative real-time RTPCR. Human GFAP primer probe sets RTS38621 (described herein above), RTS38024 (forward sequence AACCGGATCACCATCCC, designated herein as SEQ ID NO:2892: reverse sequence CCTTGT-GATTTTCCCCGTCT, designated herein as SEQ ID NO: 1064; probe sequence TGCTTTTGCCCCCTCGAATCTG, designated herein as SEQ ID) NO: 2894), and RTS38622 (forward sequence AACCGGATCACCATTCCC, designated herein as SEQ ID NO: 2892; reverse sequence GTCTTCACCACGATGTCCTC, designated herein as SEQ ID NO: 2896; probe sequence CAC-CAAGTCTGTGTCAGAAGGCCA, designated herein as SEQ ID NO: 2897) were used to measure RNA levels. GFAP RNA levels were normalized to total GAPDH, as measured by human primer probe set RTS104 (forward sequence GAAGGTGAAGGTCGGAGTC, designated herein as SEQ ID NO: 2898; reverse sequence GAAGATGGTGATGG-GATTTC, designated herein as SEQ ID NO: 2899; probe sequence CAAGCTTCCCGTCTCAGCC, designated herein as SEQ ID NO: 2900). Results are presented as percent of GFAP RNA, relative to untreated control cells (% UTC). The half maximal inhibitory concentration ($IC_{50}$) of each modified oligonucleotide was calculated using a linear regression on a log/linear plot of the data in Excel.

TABLE 113

Dose-dependent reduction of human GFAP RNA in U251 cells by modified oligonucleotides

| Compound No. | GFAP RNA (% UTC) RTS38621 123 nM | 370 nM | 1100 nM | 3300 nM | 10000 nM | $IC_{50}$ (μM) |
|---|---|---|---|---|---|---|
| 1072813 | 111 | 77 | 62 | 28 | 16 | 1.6 |
| 1166721 | 81 | 63 | 30 | 19 | 15 | 0.6 |
| 1166874 | 86 | 62 | 34 | 15 | 15 | 0.6 |

TABLE 113-continued

Dose-dependent reduction of human GFAP RNA in U251 cells by modified oligonucleotides

| Compound No. | GFAP RNA (% UTC) RTS38621 123 nM | 370 nM | 1100 nM | 3300 nM | 10000 nM | $IC_{50}$ (μM) |
|---|---|---|---|---|---|---|
| 1166895 | 91 | 94 | 68 | 40 | 21 | 2.5 |
| 1166954 | 69 | 52 | 35 | 14 | 12 | 0.4 |
| 1047582 | 54 | 26 | 13 | 6 | 5 | 0.1 |

TABLE 114

Dose-dependent reduction of human GFAP RNA in U251 cells by modified oligonucleotides

| Compound No. | GFAP RNA (% UTC) RTS38622 123 nM | 370 nM | 1100 nM | 3300 nM | 10000 nM | $IC_{50}$ (μM) |
|---|---|---|---|---|---|---|
| 1072813 | 84 | 70 | 34 | 20 | 9 | 0.7 |
| 1166721 | 78 | 47 | 27 | 15 | 11 | 0.4 |
| 1166874 | 80 | 49 | 27 | 9 | 7 | 0.4 |
| 1166895 | 89 | 83 | 62 | 35 | 17 | 1.8 |
| 1166954 | 68 | 50 | 27 | 9 | 5 | 0.3 |
| 1047582 | 51 | 24 | 10 | 3 | 1 | 0.1 |

TABLE 115

Dose-dependent reduction of human GFAP RNA in U251 cells by modified oligonucleotides

| Compound No. | GFAP RNA (% UTC) RTS38624 123 nM | 370 nM | 1100 nM | 3300 nM | 10000 nM | $IC_{50}$ (μM) |
|---|---|---|---|---|---|---|
| 1072813 | 98 | 86 | 78 | 61 | 54 | 10.6 |
| 1166721 | 87 | 66 | 43 | 28 | 21 | 1.0 |

TABLE 115-continued

Dose-dependent reduction of human GFAP RNA in U251 cells by modified oligonucleotides

| Compound No. | GFAP RNA (% UTC) RTS38624 123 nM | 370 nM | 1100 nM | 3300 nM | 10000 nM | $IC_{50}$ (μM) |
|---|---|---|---|---|---|---|
| 1166874 | 70 | 90 | 57 | 50 | 54 | 9.0 |
| 1166895 | 88 | 90 | 71 | 52 | 34 | 4.0 |
| 1166954 | 77 | 69 | 67 | 53 | 50 | 6.9 |
| 1047582 | 68 | 56 | 47 | 41 | 43 | 1.2 |

TABLE 116

Dose-dependent reduction of human GFAP RNA in U251 cells by modified oligonucleotides

| Compound No. | GFAP RNA (% UTC) RTS38621 123 nM | 370 nM | 1100 nM | 3300 nM | 10000 nM | $IC_{50}$ (μM) |
|---|---|---|---|---|---|---|
| 1166985 | 88 | 79 | 49 | 33 | 18 | 1.3 |
| 1166986 | 82 | 71 | 55 | 31 | 23 | 1.3 |
| 1166998 | 74 | 97 | 37 | 23 | 15 | 1.1 |
| 1167056 | 64 | 38 | 23 | 12 | 10 | 0.2 |
| 1199983 | 70 | 53 | 37 | 17 | 10 | 0.4 |
| 1048182 | 69 | 53 | 30 | 15 | 10 | 0.4 |

TABLE 117

Dose-dependent reduction of human GFAP RNA in U251 cells by modified oligonucleotides

| Compound No. | GFAP RNA (% UTC) RTS38622 123 nM | 370 nM | 1100 nM | 3300 nM | 10000 nM | $IC_{50}$ (μM) |
|---|---|---|---|---|---|---|
| 1166985 | 79 | 71 | 44 | 28 | 16 | 0.9 |
| 1166986 | 83 | 68 | 53 | 30 | 23 | 1.2 |
| 1166998 | 72 | 94 | 37 | 23 | 15 | 1.0 |
| 1167056 | 64 | 38 | 21 | 9 | 6 | 0.2 |
| 1199983 | 72 | 62 | 40 | 18 | 11 | 0.6 |
| 1048182 | 79 | 50 | 36 | 19 | 13 | 0.5 |

TABLE 118

Dose-dependent reduction of human GFAP RNA in U251 cells by modified oligonucleotides

| Compound No. | GFAP RNA (% UTC) RTS38624 123 nM | 370 nM | 1100 nM | 3300 nM | 10000 nM | $IC_{50}$ (μM) |
|---|---|---|---|---|---|---|
| 1166985 | 80 | 75 | 54 | 44 | 25 | 1.8 |
| 1166986 | 86 | 73 | 65 | 43 | 31 | 2.5 |

TABLE 118-continued

Dose-dependent reduction of human GFAP RNA in U251 cells by modified oligonucleotides

| Compound No. | GFAP RNA (% UTC) RTS38624 123 nM | 370 nM | 1100 nM | 3300 nM | 10000 nM | $IC_{50}$ (μM) |
|---|---|---|---|---|---|---|
| 1166998 | 76 | 111 | 53 | 32 | 17 | 1.8 |
| 1167056 | 80 | 72 | 62 | 53 | 55 | 10.6 |
| 1199983 | 77 | 65 | 52 | 31 | 20 | 1.0 |
| 1048182 | 92 | 69 | 52 | 33 | 20 | 1.3 |

Example 11: Effect of Modified Oligonucleotides on Human GFAP RNA Vitro, Multiple Doses Modified oligonucleotides selected from the examples above were tested at various doses in U251 cells. Cultured U251 cells at a density of 20,000 cells per well were treated using free uptake with various concentrations of modified oligonucleotide as specified in the tables below. After a treatment period of approximately 48 hours, total RNA was isolated from the cells and GFAP RNA levels were measured by quantitative real-time RTPCR. Human GFAP primer probe sets RTS37485 (described herein above) was used to measure RNA levels. GFAP RNA levels were normalized to total GAPDH, as measured by human primer probe set RTS104 (described herein above). Results are presented as percent of GFAP RNA, relative to untreated control cells (% UTC). The half maximal inhibitory concentration ($IC_{50}$) of each modified oligonucleotide was calculated using a linear regression on a log/linear plot of the data in Excel.

TABLE 113

Dose-dependent reduction of human GFAP RNA in U251 cells by modified oligonucleotides

| Compound No. | GFAP RNA (% UTC) RTS37485 250 nM | 740 nM | 2220 nM | 6670 nM | 20000 nM | $IC_{50}$ (μM) |
|---|---|---|---|---|---|---|
| 1072813 | 105 | 102 | 80 | 59 | 34 | 10 |
| 1166721 | 92 | 83 | 64 | 49 | 32 | 7 |
| 1166874 | 81 | 78 | 55 | 38 | 22 | 4 |
| 1166895 | 83 | 89 | 85 | 78 | 73 | 950 |
| 1166926 | 97 | 93 | 79 | 73 | 58 | 31 |
| 1166927 | 89 | 86 | 78 | 76 | 52 | 28 |
| 1166954 | 92 | 90 | 77 | 67 | 58 | 29 |
| 1166985 | 104 | 108 | 104 | 94 | 80 | 43 |
| 1166986 | 94 | 92 | 95 | 84 | 82 | 1063 |
| 1166998 | 91 | 91 | 77 | 59 | 42 | 12 |
| 1167056 | 77 | 55 | 32 | 17 | 12 | 1 |
| 1167058 | 85 | 59 | 41 | 18 | 15 | 1 |
| 1199983 | 94 | 88 | 73 | 62 | 49 | 17 |

SEQUENCE LISTING (2906 sequences)

SEQ ID NO: 1 - RNA, 3097 nt, Homo sapiens
  source 1..3097: mol_type = mRNA
atcgccagtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttccccaaaaaaaaaaaa

SEQ ID NO: 2 - DNA, 16000 bp, Homo sapiens
  source 1..16000: mol_type = genomic DNA
aaatctggtagtgtttatctccaggtggcaaaatgatggctaattacatttttttgtattgcttatctatagtttctgacctttctacaatgaatatttaattaaaaagataatgaaagtttggaacacaaccacgaccaaatctgtctgtatctttggttctctgtgcagacacctttagatagttaagggttggccaggcgtgatctatatgtaccggttgtataggtcatgcctgtaatcccagcactttgggaggaagaggtgggagggtcacttgagcccaacagttcgagaccagcctgggcaacatggcgaaaccttgtctctagtaaaatacaaaaatgagctgggcatggtggtgtatctctgtggtcccagctactagagaggctgaggtgggtggatcgcttgagccagggagattgaggctgtagtgagctgtgatagcaccacttcactctagcctgggcaacagagcaagaccctgtctcaaaaaacaaaaacaagatagttaagggttgagtgtgaggaaaggtctgagggttgagaaggggtggaggatgcacctgggcctatgacaggggtccacggaggtggctgatggcaaaagctgggggactccaactgctgatgctgaaacaagcttgtgtctcacatacacagggacagttcactgagcttcaatgacaggcacctcctgctcatcacatcttttctctctaggacagctttgcccttattttaactagacttcccttgaaccaaaagggaaggctacatgctgtgacttgctgggcagcctggaaaggcgggccactcctagccacagagatgagacagagttcagacaagagcttatccccagtcttccttttctattttgtttattttattttatttttttatttattgagacagagtctctgtcacccaggctggggtgcagtgatgcgacattggcttactgcagtctccacctcctgggctcaggtgatcctcccacctcagcctcccgaatagctgggatcacagtagtgcaccaccatacctggctaatttttttgtattttttgtacagacaaaatttcaccacattgcccaggctggtctcgaactcctggactcaagcgatccgcccacctcagcctcccaaagtgctcggattacaggcatgagccactatgcccagccttgctcttcctttaaagcctcctgtccttccccaggtccccagttcatagcaggatcaaaggtcactgggcgctcaccccgtcttcaagatgctctttcctatgtcactgcttacgcccaggtcagatgtgactagagcctaaggagctcccacctccctctctgtgctgggactcacagagggagacctcaggaggcagtctgtccatcacatgtccaaatgcagagcataccctgggctgggcgcagtggcgcacaactgtaattccagcactttgggaggctgatgtggaaggatcacttgagcccagaagttctagaccagcctgggcaacatggcaagaccctatctctacaaaaaaagttaaaaaatcagccacgtgtggtgacacacacctgtagtcccagctattcaggaggctgaggtgaggggatcacttaaggctgggaggttgaggctgcagtgagtcgtggttgcgccactgcactccagcctgggcaacagtgagaccctgtctcaaaagacaaaaaaaaaaaaaaaaaaaaaaagaacatatcctggtgtggagtaggggacgctgctctgacagaggctcgggggcctgagctggctctgtgagctggggaggaggcagacagccaggccttgtctgcaagcagacctggcagcattgggctggccgccccccagggcctcctcttcatgcccagtgaatgactcaccttggcacagacacaatgttcggggtgggcacagtgcctgcttcccgccgcaccccagcccccctcaaatgccttccgagaagcccattgagcagggggcttgcattgcaccccagcctgacagcctggcatcttgggataaaagcagcacagccccctaggggctgcccttgctgtgtggcgccaccggcggtggagaacaaggctctattcagcctgtgcccaggaaaggggatcaggggatgcccaggcatggacagtgggtggcagggggggagaggagggctgtctgcttcccagaagtccaaggacacaaatgggtgaggggactgggcagggttctgaccctgtgggaccagagtggagggcgtagatggacctgaagtctccagggacaacagggcccaggtctcaggctcctagttgggcccagtggctccagcgtttccaaacccatccatccccagaggttcttcccatctctccaggctgatgtgtgggaactcgaggaaataaatctccagtgggagacggaggggtggccagggaaacggggcgctgcaggaataaagacgagccagcacagccagctcatgtgtaacggctttgtggagctgtcaaggcctggtctctgggagagaggcacagggaggccagacaaggaaggggtgacctggagggacagatccaggggctaaagtcctgataaggcaagagagtgccggccccctcttgccctatcaggacctccactgccacatagaggccatgattgacccttagacaaagggctggtgtccaatcccagcccccagccccagaactccagggaatgaatgggcagagagcaggaatgtgggacatctgtgttcaagggaaggactccaggagtctgctgggaatgaggcctagtaggaaatgaggtggcccttgagggtacagaacaggttcattcttcgccaaattcccagcaccttgcaggcacttacagctgagtgagataatgcctgggttatgaaatcaaaaagttggaaagcaggtcagaggtcatctggtacagcccttccttcccttttttttttttttttttgtgagacaaggtctctctctgttgcccaggctggagtggcgcaaacacagctcactgcagcctcaacctactgggctcaagcaatcctccagcctcagcctcccaaagtgctgggattacaagcatgagccaccccactcagccctttccttcctttttaattgatgcataataattgtaagtattcatcatggtccaaccaaccctttcttgacccaccttcctagagagagggtcctcttgcttcagcggtcagggccccagacccatggtctggctccaggtaccacctgcctcatgcaggagttggcgtgcccaggaagctctgcctctgggcacagtgacctcagtggggtgaggggagctctccccatagctgggctgcggcccaaccccaccccctcaggctatgccagggggtgttgccaggggcacccgggcatcgccagtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagtgaggaggggatggggaaggggggccttgtgagcagaaggggctgaatccccaagaaggagtgcccgagaagtctcagggaggggccgaacctccctgctccctgggcctccctacctcttgatggggcactatccttgccccccaacatgatgggagggaccagaaacaggcccagggccccggggatctgatgcccgcatgccttctgccaggagtccagggtcccctcagcacctccctactggggaaagcagtgcaggagcagcggggcccctgtgtttcattcatggctgggctttgtgactgtgggcagcgagctcacctattctgagcctgtgtccatataaaggaggagttggaagcggagaaggttgatgtccatgagggagattggattctggggtgaagaaagtgagggaaagagcaggcaggtctgggcgcaaagcacaggtgactgcctgccaccagcttgtgacccccatcaagttactttgacttgcacagctgtgaagcggtggtcataataaaattcatttcaaaaggtggttacctgggatcagaggaatccccaggggcatggcgcttcactgagctgacaggacatgcatgtgtgccttcaagtgcaggaggacatgtgcgtgtgtgtgtgtgtgtgtgcaacagtgagtgtatgcttgtggatgcgcctgtgtgagcagaagcaggtgcaccaaccctgataaggcaccttagtaatgagttaaggcaaaagcccacatctgctcatcctccagacaagtcctctgtctaaggccccccaacccttaatcctcctgctgctctactggtcctgggtgggggtggtctctgtgacagctgcctcaagggagactgaggcaggtattcaagtgtcctcagaagagcctggacccaggaatgtgtccccccactccaggctccaggatgaaaccaacctgaggctggaagccgagaacaacctggctgcctatagacaggtcagggaggtggaggggaggggcaggggagggaggaaaggattgatggccacccacccaaacacagcccccaagctcagcccgccagagcaatgtgctgctccccactgccccagaaggaggggtaaggcaaggctgaggaatggggagaaggagcctggggccccagtggccctctactcctcacccctcctgccactccaggaagcagatgaagccaccctggcccgtctggatctggagaggaagattgagtcgctggaggaggagatccggttcttgaggaagatccacgaggaggtgaggccagggcagagggaggaaagctcaacacagagattgcaactgagagagggagagacagagacagagaagctgagactgagagagacactcagagagaggagagaaacagagattggcaggtagagacaggaaatgaaagacaaacagaaagacactaagggagacggaaagagacaagagagcattcgaactcctggccgaggggcaggcagaagaggacacaatggcgtggggaaccccagctgtggcctgtaccctgagccctggtaccgcttctctcaccctggtcaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaaggtagccctgcctgtgggccagcctgcctcctccaggcagcccttcttgctctgtacaagagaatgggggaaggagggtggaggaagctgggagaatatcctctccaggtgactgactttcaccagagaagtgagatggcttgcccagggtcacacaggcactattgctttcaaaagtacccattattattactgctactattgctattattagtagtagctgatactgttctgttctaagccctgtgcttttcatggattaccttactatgaagtaggtgctgttctttgacagatgagagagccgaagtccagagaggttaactaatttgctcaaagtcacacagctcctaagtggtagagttggatttccaactctagcacatctcacttgggagcctgcattccatgcctctgccagtctgttttgggttactgagcctctaccatatgccaggcaccccccaggacacagagaggtgtctgacctggaaggtgtgatattgacgtgcacccaaacatagtgcccgtagagaacaccacagctcagagcttatatgtagtgtgggagccaggaaagacactgtagagggggcatttgggctaggcaggacaggcacgctgtggacaggaagagaagaagggagggccattcctagtggaggacagagcctggaggcagaaaagcacagagaggcagggccccaagatgctagcctagccagggcacctagctgaggagtgtgagtggcagaagccactggtgtctgagcagggtgagggcccgatggggctgggaggacctccctgcaggcaggggagaaagggctattagaacccagggtgaggccaggcgaggtggctcacacctgtaatcccagcactttgggaggccgaggcatgcggatcacctgaggtcagcagttcaagactagcctggtcaacatggtgaaaccccgtctctactaaaaatacaaaatcagccgggtgtagtggcgcatgcctgtaatcccagctactcaggtggctggggcaggagaattgcttgaacctgggaggcagaggttgcagtgacccgggattgtgccactgacttccaacctgggcgacaagagcaagactctgtctcaaaataaaacaaaaaaaacaaaaaaacaaaaacacacaaaacacccaggcctccgctcgcctaagacgacagcgttcagtcccgcagatgcagctgtcagtgtggaaggttctggattctgtggcactgttcattcattcgcttgctgaccaggtgttgtgctaggtgctgaggtctggcagcccgctaccctgcccgcatccatgggtcacagttgttgggaaaagtcccagccagggccaacgtcctggggttaactggggtgctgctcacctccctgatttcccagagcccgtgcctgcccatgggcccacacagccccccatatgtgtcccccacctagtttgcagacctgacagacgctgctgcccgcaacgcggagctgctccgccaggccaagcacgaagccaacgactaccggcgccagttgcagtccttgacctgcgacctggagtctctgcgcggcacggtgagcgcggccagggcaggacggggacgggcggagcagggacggccaccccaggagatgccaggggagaagggccagggacgaggacctgggtcgagggcggggcctgaacgttacccccgggctagaggcggggcctggggccgggggccgggcctcgaaacctccccaagtcgggtcggggctccgcgggaccggccggctccatcccacagaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggtgagccctcatcacagcccctggggaagtctccctgctgcctcacggtagagctcatcttgctcccttcagggactgagtctttttcagccttgtgtgcagatcccttcccacctcaatgcccagcacagtgcctgcctcacacatagcaggcagtcactagatgtttgatgactgaatggatggatggattcaaccaatattgattaggcctcaaggccaaggacttgggtcaccctccaaactaagaggcatactccccatcttcccagccaagattggactcctcacctcacccatctcttctgcctccttggaactttcttcaccactttcccctcccttttccatcttccttcagatagacatgcgcccctcccagataacactcaagccccttgcagacgtttggaactccagatagcacgttggctgctggggaaaaagctaggagatggagttagactttcctggcaaggaaaagggcgttcaagttgtcatgatggccccgcaccaagacccagcctaggggtgtcccaggcagcccgggcagccctctccctctgctttctttcaggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagcttgacatctgccctgtctgcagatccctgagcaagcactgcccttctgagtgttttctgtttttgtttttttaactgcttgtcactacagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgttaaatattagtgaatgtgacgtgttatatttttctctctcgggcggggcggggggaggggggagctaaattactttttacttgcattggccctgaaatgattcttagctaaggaacaaaattcctcttcttctggactagaatatttaggaccactagatatgcatgtctcaggacttaattcagcatcagaaaggctaaccaggctgactagtagaggtaatactgccaaatcctagatagtcacaggtcactaaagcacagataaatggcagagagaagtaggaaagaggaaaggggacaggaaagggacctatgtgtattgagcactaatatgtgccacatgtttaacagcctttattttagttaattgtctcctctctcccacctagagaagtaggccccatcatccttattttacagatgaggaaactgaggctgggagaggtcaattaacttgcccagagtcatgtggctggttggtggctaagttgggacttcttgagctctggtctcctgatccttccttccttccttccttcttttcttccttccttccttctttccttccttccttcggcagagcgtccctctgtcactcaggctggaatgcagtagtgcaatcttggctcactgcaacctccacctcccaggttcaagcaattctcgtgcctcagactcccgagtaaggggattacaggtgcgagccaccacacctggctaatctttctttttctttctttctttctttcttccttccttccttccttccttcctttctctttcctgcttgcttgcttgcttgcttgcctgctttcgacggagtcttactctgttgctcaggctggagtgcagtggcacgatcgcagcttactgcaacctccgcctcccaggttcaagtgattctcctctctcagcctcctgagtagctgggactacaggcacctgtcaccatgcctgactaatttttgtatttttagtagagacagggtttcaccatattagtcaggctggtctcaaactcctgacctcaggcgatccacctgcctcggcctcccaaagtgctgggattacaggtgtgagccaccatgcctggcctattttttgtatttttagtagaggtttcactatgttggccaggctggtctcgaactcctggcgtcaggtgatccacctgcctcagcctcccaaaatgatggcattataggtgtgagccaccgcacccctcctggtctcctgatttcaataccgtgctgggttttcagaaagccaggtgccaggccagggcttgcagaggggctgaaatgaagccaggccagaagacagagcagccaggactctggcagcagcactattgggatttgggggctctccagcccgtttggaagagcctaggctctctctgctcggttgcataggttctcatactcatgatggggaggggggtgcgatggggaagccgggcatgggagaggatggctcatgccctgaaagtccatgagaggcctcctctccccacatctgcagaaaccagcctggacaccaagtctgtgtcagaaggccacctcaagaggaacatcgtggtgaagaccgtggagatgcgggatggagaggtaaggagggatttgggcccagtcaggctctggctggccccagggattctcaaggccaggccatggaggaaagcctggggctggcacatagaaggttcccagcaactcccagtagctccccagggaattctggaggagagcaaggaaactgaatgtaattccgtttcctcagtccctccataggctgttctaaggggagccttggtaccaaagccactagatgggatcctaatacacactctctctttctcaccctcaaactcgggggccttgcttgccagggagagaaagagaattaaagttagtagctttcacttccaactctagcagacacagttggggatggggagggctttccatttccagcttggtaaaaggaaactaccaggggaatgggaagaggggatttggcgtatccgccacgccactccaaccacagtgggagctcatcttactccagcagcttaccactcgccaggcatgacgctaaatgctttcccagtgttatctcaccaccccctctgtccaccacgcaaggcagctgtggttactatcaagaaaagtaagacctgggaagtcggggacttcccaaggttacacagcctcgtggtggtggacctggggtctgtgtgaactcctaactgttgcactgtgcacgttccctgtcccctgcaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttccccagagtggactctgatctgttcatgagagggcgggactggggccaagatgtagcctttgacaagaccaactcatttcttattactgatcatctctggggcccatgccctcaccaaattccacccgcagccaaagaggacatacaccagctccctccactcttttcttccttcctctccctgctacctgcaactcaaccagcacaatcttcataggcaagaaagcaaagcagctcaaacatgattcaacactgatcagtgtttaccactggataaatctgagttcacactttccttctctgacctaaatgtgaagtcaggaaacacatgtgccctacttccatcctgagctcagtccccaatctcccaccagcctcaggcccctccacttctcagatcaggtcccagacctgcccatgaaaatggggagcaggctgtaacagatttgtccacatgttcctaccacctgtcccaacccagggtacccacccagagacatctggtatcatttaacaaacacattgaaggacaactggtcttcagagctgaagagagctcctagggggagaagctgggacaacagtgaaataagtagcagcagcaacgacagaagtgaatggtgacaaagactgctgtgatgagcaggtagcctatcagggtgagctccacagccgagcgagtctcaggatctgagaacgaggctgggtagtgcccatgagatgtcacacccagccggaagccagcaactagcacaccctgcctccagcaatagtagatgccccggtcatccagctgggtgaagcggatgtggagctggttgccgtggtcaatgaacaccctcatggacctgttgacacccttcaggtactgtgtgcggtagaggtgctggcggtctttgtcccaggccactgcatgctctggccgggccccaggacaggagatgatgagtccatggcccagtctctgctggtggaactgaatgggcacctggggcacccagggccggctgcccactttggacacatagttaatgatggccagcacgccctcccggatggtctttgtcttctcacagggtactaagcagctccgaaccagcacctcaggcgtgtggtccctggccttggtccgcagcttccttggcacagcccttgagccacaagacaccacatcgggcacggccttgaggtagcgtggggagaggtctgggctctgcaggtagcagaggccgatgcgccactgctccccacgcactccgcagcggtcacagggggtccattcccagaaggtggtgaagacatggaggtgcccatagtattcatctgcaaagggctcctggcccttgtcctggaaagtggccaccattccctcactgttctggatgtccacatcgtaggcgtaaaagtagtcccccttgcgggtgccgcagaagtacaggcctgagtcctcagactgagccctgaaaaccaacaagctgaacatgcggatgctgaagcgggtcagcatgtcgctgcccacacgtacctgggctgcctccgtcagcacccgcccatcaaagtccgtcagcactttggtgtggctgctacctaggtgcttttggtagaaccagactacagctggcacctcttcgggtttgcagtgacagggaagctcaaagctcatgtcggccaggtaggctgcattttcaaacatcaggaaagcagggcagggggtcctctgaaaaatgttttccttctccacaatttcaaaggcctggagcccccatgcccacaggagcacagtggtgagggccaggtgcatacctgaaggaggcaggggtcagaggggcagggcaaaaccagggcattaaaggctcatagggctcctagaaagctctgctaagcggaagcctctagatgaggaaaggattatgcagccaggaaaagcagcaacaatctgcagaggaagccgccaagtgcaaggcaatttattcccagtggatgtacaagatgcccttctaacattccagacctgatctcagggtggggggggaaagccattctagaacctggcctttactcccctttctagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggtttggggctataaacattcttgttaagagctgtggagatcagtgtttgtttaccataaagattttgctttttcccttttatgagtggaggctgtaactggtatagccagcatttggttgggcacacactcatctctcaaggccagtgggctagaggcttggcagactctaagggtgggaaacaaaaccgctctcaacttcctgagctcttgactgtccatggatacacacagttcaaa

SEQ ID NO: 3 - RNA, 1839 nt, Homo sapiens
  source 1..1839: mol_type = mRNA
atcgccagtctagcccactccttcataaagccctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacgaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgttaaatattaaaaaaaaa

SEQ ID NO: 4-10 - skipped (7 entries)

SEQ ID NO: 11 - DNA, 19 bp, Synthetic construct
  source 1..19: mol_type = other DNA
ctggaggttgagagggaca

SEQ ID NO: 12 - DNA, 20 bp, Synthetic construct
  source 1..20: mol_type = other DNA
gcttcatctgcttcctgtct

SEQ ID NO: 13 - DNA, 23 bp, Synthetic construct
  source 1..23: mol_type = other DNA
ctggagcttctgcctcacagtgg

SEQ ID NO: 14 - DNA, 19 bp, Synthetic construct
  source 1..19: mol_type = other DNA
agttgcagtccttgacctg

SEQ ID NO: 15 - DNA, 19 bp, Synthetic construct
  source 1..19: mol_type = other DNA
cagcgcctcctgataactg

SEQ ID NO: 16 - DNA, 23 bp, Synthetic construct
  source 1..23: mol_type = other DNA
acgagtccctggagaggcagatg

SEQ ID NO: 17 - DNA, 15 bp, Synthetic construct
  source 1..15: mol_type = other DNA
tcgccgcttgctgca

SEQ ID NO: 18 - DNA, 17 bp, Synthetic construct
  source 1..17: mol_type = other DNA
atcggccgtgatgtcga

SEQ ID NO: 19 - DNA, 23 bp, Synthetic construct
  source 1..23: mol_type = other DNA
ccatggtcaaccccaccgtgttc

SEQ ID NO: 20 - DNA, 20 bp, Synthetic construct
  source 1..20: mol_type = other DNA
cagtattacctctactagtc

SEQ ID NO: 21 - DNA, 20 bp, Synthetic construct
  source 1..20: mol_type = other DNA
cacattcactaatatttaac

SEQ ID NO: 22 - DNA, 20 bp, Synthetic construct
  source 1..20: mol_type = other DNA
cgagggctttatgaaggagt

SEQ ID NO: 23 - DNA, 20 bp, Synthetic construct
  source 1..20: mol_type = other DNA
gccaggagccaggcccccca

SEQ ID NO: 24 - DNA, 20 bp, Synthetic construct
  source 1..20: mol_type = other DNA
ggcccgggtctccttgaagc

SEQ ID NO: 25 - DNA, 20 bp, Synthetic construct
  source 1..20: mol_type = other DNA
gtcctgtgccagattgtccc

SEQ ID NO: 26 - DNA, 20 bp, Synthetic construct
  source 1..20: mol_type = other DNA
catctgcttcctgtctatag

SEQ ID NO: 27 - DNA, 20 bp, Synthetic construct
  source 1..20: mol_type = other DNA
ctcaagaaccggatctcctc

SEQ ID NO: 28 - DNA, 20 bp, Synthetic construct
  source 1..20: mol_type = other DNA
actcttcggcttcatgcatg

SEQ ID NO: 29 - DNA, 20 bp, Synthetic construct
  source 1..20: mol_type = other DNA
gcgcctcctgataactggcc

SEQ ID NO: 30 - DNA, 20 bp, Synthetic construct
  source 1..20: mol_type = other DNA
cttctgacacagacttggtg

SEQ ID NO: 31 - DNA, 20 bp, Synthetic construct
  source 1..20: mol_type = other DNA
atcccgcatctccacggtct

SEQ ID NO: 32 - DNA, 20 bp, Synthetic construct
  source 1..20: mol_type = other DNA
ctgcctcacatcacatcctt

SEQ ID NO: 33 - DNA, 20 bp, Synthetic construct
  source 1..20: mol_type = other DNA
cggagcaactatcctgcttc

SEQ ID NO: 34 - DNA, 20 bp, Synthetic construct
  source 1..20: mol_type = other DNA
aagctgctggccatgcccct

SEQ ID NO: 35 - DNA, 20 bp, Synthetic construct
  source 1..20: mol_type = other DNA
tgccccccgccctcctcccc

SEQ ID NO: 36 - DNA, 20 bp, Synthetic construct
  source 1..20: mol_type = other DNA
gagagaacctccatctctgg

SEQ ID NO: 37 - DNA, 20 bp, Synthetic construct
  source 1..20: mol_type = other DNA
tcagttttcctccagcagcc

SEQ ID NO: 38 - DNA, 20 bp, Synthetic construct
  source 1..20: mol_type = other DNA
gacaaaacaagcctctggcc

SEQ ID NO: 39 - DNA, 20 bp, Synthetic construct
  source 1..20: mol_type = other DNA
cgtccccacccatcttagac

SEQ ID NO: 40 - DNA, 20 bp, Synthetic construct
  source 1..20: mol_type = other DNA
gtgctgagaatcaagctccc

SEQ ID NO: 41 - DNA, 20 bp, Synthetic construct
  source 1..20: mol_type = other DNA
ccccctctatccctcccagc

SEQ ID NO: 42 - DNA, 20 bp, Synthetic construct
  source 1..20: mol_type = other DNA
ctgggcttgacctctctgta

SEQ ID NO: 43 - DNA, 20 bp, Synthetic construct
  source 1..20: mol_type = other DNA
tggtcacccacaacccctac

SEQ ID NO: 44 - DNA, 20 bp, Synthetic construct
  source 1..20: mol_type = other DNA
ccctttctctcctgtttcag

SEQ ID NO: 45 - DNA, 20 bp, Synthetic construct
  source 1..20: mol_type = other DNA
aagtcatgccctgcccccat

SEQ ID NO: 46 - DNA, 20 bp, Synthetic construct
  source 1..20: mol_type = other DNA
gcacccggcctccaggctgc

SEQ ID NO: 47 - DNA, 20 bp, Synthetic construct
  source 1..20: mol_type = other DNA
ggcacagatcccaccagtct

SEQ ID NO: 48 - DNA, 20 bp, Synthetic construct
  source 1..20: mol_type = other DNA
gagaggagaaccctgaagtg

SEQ ID NO: 49 - DNA, 20 bp, Synthetic construct
  source 1..20: mol_type = other DNA
cctcagcgactaaaggcagc

SEQ ID NO: 50 - DNA, 20 bp, Synthetic construct
  source 1..20: mol_type = other DNA
gcgcagcatttgtctttatt

SEQ ID NO: 51 - DNA, 20 bp, Synthetic construct
  source 1..20: mol_type = other DNA
gcttttgagatatcttgtga

SEQ ID NO: 52 - DNA, 20 bp, Synthetic construct
  source 1..20: mol_type = other DNA
gtttaatgtacagttactct

SEQ ID NO: 53 - DNA, 20 bp, Synthetic construct
  source 1..20: mol_type = other DNA
ccaaggactcaccaccttta

SEQ ID NO: 54 - DNA, 20 bp, Synthetic construct
  source 1..20: mol_type = other DNA
agggatgaaagaataaagca

SEQ ID NO: 55 - DNA, 20 bp, Synthetic construct
  source 1..20: mol_type = other DNA
cctgctgtactgacctcgaa

SEQ ID NO: 56 - DNA, 20 bp, Synthetic construct
  source 1..20: mol_type = other DNA
atcctcagtcccagtctgga

SEQ ID NO: 57 - DNA, 20 bp, Synthetic construct
  source 1..20: mol_type = other DNA
ctgcagtgtcacgaaggccc

SEQ ID NO: 58 - DNA, 20 bp, Synthetic construct
  source 1..20: mol_type = other DNA
tgtcaagctctcacccagtt

SEQ ID NO: 59 - DNA, 20 bp, Synthetic construct
  source 1..20: mol_type = other DNA
ttggtgcttttgccccctgt

SEQ ID NO: 60 - DNA, 20 bp, Synthetic construct
  source 1..20: mol_type = other DNA
ggatagtgccccatcaagag

SEQ ID NO: 61 - DNA, 20 bp, Synthetic construct
  source 1..20: mol_type = other DNA
agtcacaaagcccagccatg

SEQ ID NO: 62 - DNA, 20 bp, Synthetic construct
  source 1..20: mol_type = other DNA
gcttccaactcctcctttat

SEQ ID NO: 63 - DNA, 20 bp, Synthetic construct
  source 1..20: mol_type = other DNA
cagaatccaatctccctcat

SEQ ID NO: 64 - DNA, 20 bp, Synthetic construct
  source 1..20: mol_type = other DNA
gctttgcgcccagacctgcc

SEQ ID NO: 65 - DNA, 20 bp, Synthetic construct
  source 1..20: mol_type = other DNA
attcctctgatcccaggtaa

SEQ ID NO: 66 - DNA, 20 bp, Synthetic construct
  source 1..20: mol_type = other DNA
ccttaactcattactaaggt

SEQ ID NO: 67 - DNA, 20 bp, Synthetic construct
  source 1..20: mol_type = other DNA
gagaccacccccacccagga

SEQ ID NO: 68 - DNA, 20 bp, Synthetic construct
  source 1..20: mol_type = other DNA
gtccaggctcttctgaggac

SEQ ID NO: 69 - DNA, 20 bp, Synthetic construct
  source 1..20: mol_type = other DNA
gtggccatcaatcctttcct

SEQ ID NO: 70 - DNA, 20 bp, Synthetic construct
  source 1..20: mol_type = other DNA
ccccaggctccttctcccca

SEQ ID NO: 71 - DNA, 20 bp, Synthetic construct
  source 1..20: mol_type = other DNA
tgtctctacctgccaatctc

SEQ ID NO: 72 - DNA, 20 bp, Synthetic construct
  source 1..20: mol_type = other DNA
ctcagggtacaggccacagc

SEQ ID NO: 73 - DNA, 20 bp, Synthetic construct
  source 1..20: mol_type = other DNA
accctccttcccccattctc

SEQ ID NO: 74 - DNA, 20 bp, Synthetic construct
  source 1..20: mol_type = other DNA
agctactactaataatagca

SEQ ID NO: 75 - DNA, 20 bp, Synthetic construct
  source 1..20: mol_type = other DNA
acttcggctctctcatctgt

SEQ ID NO: 76 - DNA, 20 bp, Synthetic construct
  source 1..20: mol_type = other DNA
aacccaaaacagactggcag

SEQ ID NO: 77 - DNA, 20 bp, Synthetic construct
  source 1..20: mol_type = other DNA
cccacactacatataagctc

SEQ ID NO: 78 - DNA, 20 bp, Synthetic construct
  source 1..20: mol_type = other DNA
cctgtcctgcctagcccaaa

SEQ ID NO: 79 - DNA, 20 bp, Synthetic construct
  source 1..20: mol_type = other DNA
gggccctgcctctctgtgct

SEQ ID NO: 80 - DNA, 20 bp, Synthetic construct
  source 1..20: mol_type = other DNA
atagccctttctcccctgcc

SEQ ID NO: 81 - DNA, 20 bp, Synthetic construct
  source 1..20: mol_type = other DNA
aatccagaaccttccacact

SEQ ID NO: 82 - DNA, 20 bp, Synthetic construct
  source 1..20: mol_type = other DNA
tgggacttttcccaacaact

SEQ ID NO: 83 - DNA, 20 bp, Synthetic construct
  source 1..20: mol_type = other DNA
cgccctcgacccaggtcctc

SEQ ID NO: 84 - DNA, 20 bp, Synthetic construct
  source 1..20: mol_type = other DNA
agtgactgcctgctatgtgt

SEQ ID NO: 85 - DNA, 20 bp, Synthetic construct
  source 1..20: mol_type = other DNA
ttggagggtgacccaagtcc

SEQ ID NO: 86 - DNA, 20 bp, Synthetic construct
  source 1..20: mol_type = other DNA
acgcccttttccttgccagg

SEQ ID NO: 87 - DNA, 20 bp, Synthetic construct
  source 1..20: mol_type = other DNA
tagctcccccctccccccgc

SEQ ID NO: 88 - DNA, 20 bp, Synthetic construct
  source 1..20: mol_type = other DNA
gcagtattacctctactagt

SEQ ID NO: 89 - DNA, 20 bp, Synthetic construct
  source 1..20: mol_type = other DNA
cctgtcccctttcctctttc

SEQ ID NO: 90 - DNA, 20 bp, Synthetic construct
  source 1..20: mol_type = other DNA
ccaccaaccagccacatgac

SEQ ID NO: 91 - DNA, 20 bp, Synthetic construct
  source 1..20: mol_type = other DNA
atcaggagaccagagctcaa

SEQ ID NO: 92 - DNA, 20 bp, Synthetic construct
  source 1..20: mol_type = other DNA
ggcctggcttcatttcagcc

SEQ ID NO: 93 - DNA, 20 bp, Synthetic construct
  source 1..20: mol_type = other DNA
agtatgagaacctatgcaac

SEQ ID NO: 94 - DNA, 20 bp, Synthetic construct
  source 1..20: mol_type = other DNA
gggcatgagccatcctctcc

SEQ ID NO: 95 - DNA, 20 bp, Synthetic construct
  source 1..20: mol_type = other DNA
gactgggcccaaatccctcc

SEQ ID NO: 96 - DNA, 20 bp, Synthetic construct
  source 1..20: mol_type = other DNA
ccttgctctcctccagaatt

SEQ ID NO: 97 - DNA, 20 bp, Synthetic construct
  source 1..20: mol_type = other DNA
gctactaactttaattctct

SEQ ID NO: 98 - DNA, 20 bp, Synthetic construct
  source 1..20: mol_type = other DNA
cctcttcccattcccctggt

SEQ ID NO: 99 - DNA, 20 bp, Synthetic construct
  source 1..20: mol_type = other DNA
ggtcttacttttcttgatag

SEQ ID NO: 100 - DNA, 20 bp, Synthetic construct
  source 1..20: mol_type = other DNA
gcgagggctttatgaaggag

SEQ ID NO: 101 - DNA, 20 bp, Synthetic construct
  source 1..20: mol_type = other DNA
cggccaggagccaggccccc

SEQ ID NO: 102 - DNA, 20 bp, Synthetic construct
  source 1..20: mol_type = other DNA
tcatctctgcccgctcactg

SEQ ID NO: 103 - DNA, 20 bp, Synthetic construct
  source 1..20: mol_type = other DNA
aggtcctgtgccagattgtc

SEQ ID NO: 104 - DNA, 20 bp, Synthetic construct
  source 1..20: mol_type = other DNA
tggcttcatctgcttcctgt

SEQ ID NO: 105 - DNA, 20 bp, Synthetic construct
  source 1..20: mol_type = other DNA
tcctcaagaaccggatctcc

SEQ ID NO: 106 - DNA, 20 bp, Synthetic construct
  source 1..20: mol_type = other DNA
gcggtaccactcttcggctt

SEQ ID NO: 107 - DNA, 20 bp, Synthetic construct
  source 1..20: mol_type = other DNA
ccctcttcctccagccgcgc

SEQ ID NO: 108 - DNA, 20 bp, Synthetic construct
  source 1..20: mol_type = other DNA
ccttctgacacagacttggt

SEQ ID NO: 109 - DNA, 20 bp, Synthetic construct
  source 1..20: mol_type = other DNA
cctctccatcccgcatctcc

SEQ ID NO: 110 - DNA, 20 bp, Synthetic construct
  source 1..20: mol_type = other DNA
cctgcctcacatcacatcct

SEQ ID NO: 111 - DNA, 20 bp, Synthetic construct
  source 1..20: mol_type = other DNA
gcggagcaactatcctgctt

SEQ ID NO: 112 - DNA, 20 bp, Synthetic construct
  source 1..20: mol_type = other DNA
cctcattctaacgcaagctg

SEQ ID NO: 113 - DNA, 20 bp, Synthetic construct
  source 1..20: mol_type = other DNA
gtgccccccgccctcctccc

SEQ ID NO: 114 - DNA, 20 bp, Synthetic construct
  source 1..20: mol_type = other DNA
tccgagagaacctccatctc

SEQ ID NO: 115 - DNA, 20 bp, Synthetic construct
  source 1..20: mol_type = other DNA
ctcagttttcctccagcagc

SEQ ID NO: 116 - DNA, 20 bp, Synthetic construct
  source 1..20: mol_type = other DNA
tcccacctcataaaaaccaa

SEQ ID NO: 117 - DNA, 20 bp, Synthetic construct
  source 1..20: mol_type = other DNA
ggtgactgccccaggtggca

SEQ ID NO: 118 - DNA, 20 bp, Synthetic construct
  source 1..20: mol_type = other DNA
agtgctgagaatcaagctcc

SEQ ID NO: 119 - DNA, 20 bp, Synthetic construct
  source 1..20: mol_type = other DNA
cccccctctatccctcccag

SEQ ID NO: 120 - DNA, 20 bp, Synthetic construct
  source 1..20: mol_type = other DNA
gtcccctccagtctgcacgg

SEQ ID NO: 121 - DNA, 20 bp, Synthetic construct
  source 1..20: mol_type = other DNA
ctggtcacccacaaccccta

SEQ ID NO: 122 - DNA, 20 bp, Synthetic construct
  source 1..20: mol_type = other DNA
cccctttctctcctgtttca

SEQ ID NO: 123 - DNA, 20 bp, Synthetic construct
  source 1..20: mol_type = other DNA
ggacaaagtcatgccctgcc

SEQ ID NO: 124 - DNA, 20 bp, Synthetic construct
  source 1..20: mol_type = other DNA
agcacccggcctccaggctg

SEQ ID NO: 125 - DNA, 20 bp, Synthetic construct
  source 1..20: mol_type = other DNA
gggcacagatcccaccagtc

SEQ ID NO: 126 - DNA, 20 bp, Synthetic construct
  source 1..20: mol_type = other DNA
cccttcttcggccttagagg

SEQ ID NO: 127 - DNA, 20 bp, Synthetic construct
  source 1..20: mol_type = other DNA
tttttcctcagcgactaaag

SEQ ID NO: 128 - DNA, 20 bp, Synthetic construct
  source 1..20: mol_type = other DNA
gggcgcagcatttgtcttta

SEQ ID NO: 129 - DNA, 20 bp, Synthetic construct
  source 1..20: mol_type = other DNA
ggcttttgagatatcttgtg

SEQ ID NO: 130 - DNA, 20 bp, Synthetic construct
  source 1..20: mol_type = other DNA
tgccagtttaatgtacagtt

SEQ ID NO: 131 - DNA, 20 bp, Synthetic construct
  source 1..20: mol_type = other DNA
acccaaggactcaccacctt

SEQ ID NO: 132 - DNA, 20 bp, Synthetic construct
  source 1..20: mol_type = other DNA
atggagcctcagggatgaaa

SEQ ID NO: 133 - DNA, 20 bp, Synthetic construct
  source 1..20: mol_type = other DNA
ccctgctgtactgacctcga

SEQ ID NO: 134 - DNA, 20 bp, Synthetic construct
  source 1..20: mol_type = other DNA
cctgatcctcagtcccagtc

SEQ ID NO: 135 - DNA, 20 bp, Synthetic construct
  source 1..20: mol_type = other DNA
cgctgcagtgtcacgaaggc

SEQ ID NO: 136 - DNA, 20 bp, Synthetic construct
  source 1..20: mol_type = other DNA
ggcagatgtcaagctctcac

SEQ ID NO: 137 - DNA, 20 bp, Synthetic construct
  source 1..20: mol_type = other DNA
tcctcacttctgcctcacag

SEQ ID NO: 138 - DNA, 20 bp, Synthetic construct
  source 1..20: mol_type = other DNA
aaggatagtgccccatcaag

SEQ ID NO: 139 - DNA, 20 bp, Synthetic construct
  source 1..20: mol_type = other DNA
cagtcacaaagcccagccat

SEQ ID NO: 140 - DNA, 20 bp, Synthetic construct
  source 1..20: mol_type = other DNA
ccgcttccaactcctccttt

SEQ ID NO: 141 - DNA, 20 bp, Synthetic construct
  source 1..20: mol_type = other DNA
cccagaatccaatctccctc

SEQ ID NO: 142 - DNA, 20 bp, Synthetic construct
  source 1..20: mol_type = other DNA
aggcagtcacctgtgctttg

SEQ ID NO: 143 - DNA, 20 bp, Synthetic construct
  source 1..20: mol_type = other DNA
gattcctctgatcccaggta

SEQ ID NO: 144 - DNA, 20 bp, Synthetic construct
  source 1..20: mol_type = other DNA
gccttaactcattactaagg

SEQ ID NO: 145 - DNA, 20 bp, Synthetic construct
  source 1..20: mol_type = other DNA
agagaccacccccacccagg

SEQ ID NO: 146 - DNA, 20 bp, Synthetic construct
  source 1..20: mol_type = other DNA
tggtttcatcctggagcctg

SEQ ID NO: 147 - DNA, 20 bp, Synthetic construct
  source 1..20: mol_type = other DNA
ggtgggtggccatcaatcct

SEQ ID NO: 148 - DNA, 20 bp, Synthetic construct
  source 1..20: mol_type = other DNA
catctgcttcctggagtggc

SEQ ID NO: 149 - DNA, 20 bp, Synthetic construct
  source 1..20: mol_type = other DNA
tctttcatttcctgtctcta

SEQ ID NO: 150 - DNA, 20 bp, Synthetic construct
  source 1..20: mol_type = other DNA
cccgaacctcctgaccaggg

SEQ ID NO: 151 - DNA, 20 bp, Synthetic construct
  source 1..20: mol_type = other DNA
gcttcctccaccctccttcc

SEQ ID NO: 152 - DNA, 20 bp, Synthetic construct
  source 1..20: mol_type = other DNA
cagctactactaataatagc

SEQ ID NO: 153 - DNA, 20 bp, Synthetic construct
  source 1..20: mol_type = other DNA
ttagttaacctctctggact

SEQ ID NO: 154 - DNA, 20 bp, Synthetic construct
  source 1..20: mol_type = other DNA
taacccaaaacagactggca

SEQ ID NO: 155 - DNA, 20 bp, Synthetic construct
  source 1..20: mol_type = other DNA
tcccacactacatataagct

SEQ ID NO: 156 - DNA, 20 bp, Synthetic construct
  source 1..20: mol_type = other DNA
gcctgtcctgcctagcccaa

SEQ ID NO: 157 - DNA, 20 bp, Synthetic construct
  source 1..20: mol_type = other DNA
gccactcacactcctcagct

SEQ ID NO: 158 - DNA, 20 bp, Synthetic construct
  source 1..20: mol_type = other DNA
tctaatagccctttctcccc

SEQ ID NO: 159 - DNA, 20 bp, Synthetic construct
  source 1..20: mol_type = other DNA
agaatccagaaccttccaca

SEQ ID NO: 160 - DNA, 20 bp, Synthetic construct
  source 1..20: mol_type = other DNA
ctgggacttttcccaacaac

SEQ ID NO: 161 - DNA, 20 bp, Synthetic construct
  source 1..20: mol_type = other DNA
aggccccgccctcgacccag

SEQ ID NO: 162 - DNA, 20 bp, Synthetic construct
  source 1..20: mol_type = other DNA
aaacatctagtgactgcctg

SEQ ID NO: 163 - DNA, 20 bp, Synthetic construct
  source 1..20: mol_type = other DNA
aaggaggcagaagagatggg

SEQ ID NO: 164 - DNA, 20 bp, Synthetic construct
  source 1..20: mol_type = other DNA
ctgggacacccctaggctgg

SEQ ID NO: 165 - DNA, 20 bp, Synthetic construct
  source 1..20: mol_type = other DNA
ttagctcccccctccccccg

SEQ ID NO: 166 - DNA, 20 bp, Synthetic construct
  source 1..20: mol_type = other DNA
tggcagtattacctctacta

SEQ ID NO: 167 - DNA, 20 bp, Synthetic construct
  source 1..20: mol_type = other DNA
tcctgtcccctttcctcttt

SEQ ID NO: 168 - DNA, 20 bp, Synthetic construct
  source 1..20: mol_type = other DNA
gccaccaaccagccacatga

SEQ ID NO: 169 - DNA, 20 bp, Synthetic construct
  source 1..20: mol_type = other DNA
ctgtaatccccttactcggg

SEQ ID NO: 170 - DNA, 20 bp, Synthetic construct
  source 1..20: mol_type = other DNA
ctgctctgtcttctggcctg

SEQ ID NO: 171 - DNA, 20 bp, Synthetic construct
  source 1..20: mol_type = other DNA
gagtatgagaacctatgcaa

SEQ ID NO: 172 - DNA, 20 bp, Synthetic construct
  source 1..20: mol_type = other DNA
agggcatgagccatcctctc

SEQ ID NO: 173 - DNA, 20 bp, Synthetic construct
  source 1..20: mol_type = other DNA
ctgactgggcccaaatccct

SEQ ID NO: 174 - DNA, 20 bp, Synthetic construct
  source 1..20: mol_type = other DNA
acattcagtttccttgctct

SEQ ID NO: 175 - DNA, 20 bp, Synthetic construct
  source 1..20: mol_type = other DNA
agctactaactttaattctc

SEQ ID NO: 176 - DNA, 20 bp, Synthetic construct
  source 1..20: mol_type = other DNA
gccaaatcccctcttcccat

SEQ ID NO: 177 - DNA, 20 bp, Synthetic construct
  source 1..20: mol_type = other DNA
ccaggtcttacttttcttga

SEQ ID NO: 178 - DNA, 20 bp, Synthetic construct
  source 1..20: mol_type = other DNA
ctcctctccatcctgctctg

SEQ ID NO: 179 - DNA, 20 bp, Synthetic construct
  source 1..20: mol_type = other DNA
gacggcggccaggagccagg

SEQ ID NO: 180 - DNA, 20 bp, Synthetic construct
  source 1..20: mol_type = other DNA
agctccatcatctctgcccg

SEQ ID NO: 181 - DNA, 20 bp, Synthetic construct
  source 1..20: mol_type = other DNA
tggccaggtcctgtgccaga

SEQ ID NO: 182 - DNA, 20 bp, Synthetic construct
  source 1..20: mol_type = other DNA
gggtggcttcatctgcttcc

SEQ ID NO: 183 - DNA, 20 bp, Synthetic construct
  source 1..20: mol_type = other DNA
gatcttcctcaagaaccgga

SEQ ID NO: 184 - DNA, 20 bp, Synthetic construct
  source 1..20: mol_type = other DNA
agcggtaccactcttcggct

SEQ ID NO: 185 - DNA, 20 bp, Synthetic construct
  source 1..20: mol_type = other DNA
cccctcttcctccagccgcg

SEQ ID NO: 186 - DNA, 20 bp, Synthetic construct
  source 1..20: mol_type = other DNA
gccttctgacacagacttgg

SEQ ID NO: 187 - DNA, 20 bp, Synthetic construct
  source 1..20: mol_type = other DNA
atgacctctccatcccgcat

SEQ ID NO: 188 - DNA, 20 bp, Synthetic construct
  source 1..20: mol_type = other DNA
tcctgcctcacatcacatcc

SEQ ID NO: 189 - DNA, 20 bp, Synthetic construct
  source 1..20: mol_type = other DNA
gcaagctgacctagggacag

SEQ ID NO: 190 - DNA, 20 bp, Synthetic construct
  source 1..20: mol_type = other DNA
tcctcattctaacgcaagct

SEQ ID NO: 191 - DNA, 20 bp, Synthetic construct
  source 1..20: mol_type = other DNA
ggtgccccccgccctcctcc

SEQ ID NO: 192 - DNA, 20 bp, Synthetic construct
  source 1..20: mol_type = other DNA
ctccgagagaacctccatct

SEQ ID NO: 193 - DNA, 20 bp, Synthetic construct
  source 1..20: mol_type = other DNA
tctcagttttcctccagcag

SEQ ID NO: 194 - DNA, 20 bp, Synthetic construct
  source 1..20: mol_type = other DNA
agcatagggatatcccacct

SEQ ID NO: 195 - DNA, 20 bp, Synthetic construct
  source 1..20: mol_type = other DNA
ggcaggtgactgccccaggt

SEQ ID NO: 196 - DNA, 20 bp, Synthetic construct
  source 1..20: mol_type = other DNA
aagtgctgagaatcaagctc

SEQ ID NO: 197 - DNA, 20 bp, Synthetic construct
  source 1..20: mol_type = other DNA
gcccccctctatccctccca

SEQ ID NO: 198 - DNA, 20 bp, Synthetic construct
  source 1..20: mol_type = other DNA
ctcctccatctctaccagcg

SEQ ID NO: 199 - DNA, 20 bp, Synthetic construct
  source 1..20: mol_type = other DNA
actggtcacccacaacccct

SEQ ID NO: 200 - DNA, 20 bp, Synthetic construct
  source 1..20: mol_type = other DNA
catcccctttctctcctgtt

SEQ ID NO: 201 - DNA, 20 bp, Synthetic construct
  source 1..20: mol_type = other DNA
cggcctggtatgacacagca

SEQ ID NO: 202 - DNA, 20 bp, Synthetic construct
  source 1..20: mol_type = other DNA
gagcacccggcctccaggct

SEQ ID NO: 203 - DNA, 20 bp, Synthetic construct
  source 1..20: mol_type = other DNA
ctgggcacagatcccaccag

SEQ ID NO: 204 - DNA, 20 bp, Synthetic construct
  source 1..20: mol_type = other DNA
ggacccttcttcggccttag

SEQ ID NO: 205 - DNA, 20 bp, Synthetic construct
  source 1..20: mol_type = other DNA
ttatttttcctcagcgacta

SEQ ID NO: 206 - DNA, 20 bp, Synthetic construct
  source 1..20: mol_type = other DNA
aagggcgcagcatttgtctt

SEQ ID NO: 207 - DNA, 20 bp, Synthetic construct
  source 1..20: mol_type = other DNA
gtgaggcttttgagatatct

SEQ ID NO: 208 - DNA, 20 bp, Synthetic construct
  source 1..20: mol_type = other DNA
tctgccagtttaatgtacag

SEQ ID NO: 209 - DNA, 20 bp, Synthetic construct
  source 1..20: mol_type = other DNA
ctgcgcacccaaggactcac

SEQ ID NO: 210 - DNA, 20 bp, Synthetic construct
  source 1..20: mol_type = other DNA
cctgagggaagaatcctctg

SEQ ID NO: 211 - DNA, 20 bp, Synthetic construct
  source 1..20: mol_type = other DNA
ccacgaggccctgctgtact

SEQ ID NO: 212 - DNA, 20 bp, Synthetic construct
  source 1..20: mol_type = other DNA
ccctgatcctcagtcccagt

SEQ ID NO: 213 - DNA, 20 bp, Synthetic construct
  source 1..20: mol_type = other DNA
ccctggtatgataggctctg

SEQ ID NO: 214 - DNA, 20 bp, Synthetic construct
  source 1..20: mol_type = other DNA
agggcagatgtcaagctctc

SEQ ID NO: 215 - DNA, 20 bp, Synthetic construct
  source 1..20: mol_type = other DNA
tcccctcctcacttctgcct

SEQ ID NO: 216 - DNA, 20 bp, Synthetic construct
  source 1..20: mol_type = other DNA
gcaaggatagtgccccatca

SEQ ID NO: 217 - DNA, 20 bp, Synthetic construct
  source 1..20: mol_type = other DNA
ccacagtcacaaagcccagc

SEQ ID NO: 218 - DNA, 20 bp, Synthetic construct
  source 1..20: mol_type = other DNA
tccgcttccaactcctcctt

SEQ ID NO: 219 - DNA, 20 bp, Synthetic construct
  source 1..20: mol_type = other DNA
ccccagaatccaatctccct

SEQ ID NO: 220 - DNA, 20 bp, Synthetic construct
  source 1..20: mol_type = other DNA
ccaccgcttcacagctgtgc

SEQ ID NO: 221 - DNA, 20 bp, Synthetic construct
  source 1..20: mol_type = other DNA
gggattcctctgatcccagg

SEQ ID NO: 222 - DNA, 20 bp, Synthetic construct
  source 1..20: mol_type = other DNA
tgccttaactcattactaag

SEQ ID NO: 223 - DNA, 20 bp, Synthetic construct
  source 1..20: mol_type = other DNA
acagagaccacccccaccca

SEQ ID NO: 224 - DNA, 20 bp, Synthetic construct
  source 1..20: mol_type = other DNA
ctgacctgtctataggcagc

SEQ ID NO: 225 - DNA, 20 bp, Synthetic construct
  source 1..20: mol_type = other DNA
gccttacccctccttctggg

SEQ ID NO: 226 - DNA, 20 bp, Synthetic construct
  source 1..20: mol_type = other DNA
tgccctggcctcacctcctc

SEQ ID NO: 227 - DNA, 20 bp, Synthetic construct
  source 1..20: mol_type = other DNA
gtctttcatttcctgtctct

SEQ ID NO: 228 - DNA, 20 bp, Synthetic construct
  source 1..20: mol_type = other DNA
tcccgaacctcctgaccagg

SEQ ID NO: 229 - DNA, 20 bp, Synthetic construct
  source 1..20: mol_type = other DNA
ccagcttcctccaccctcct

SEQ ID NO: 230 - DNA, 20 bp, Synthetic construct
  source 1..20: mol_type = other DNA
tcagctactactaataatag

SEQ ID NO: 231 - DNA, 20 bp, Synthetic construct
  source 1..20: mol_type = other DNA
aactctaccacttaggagct

SEQ ID NO: 232 - DNA, 20 bp, Synthetic construct
  source 1..20: mol_type = other DNA
gtaacccaaaacagactggc

SEQ ID NO: 233 - DNA, 20 bp, Synthetic construct
  source 1..20: mol_type = other DNA
ctcccacactacatataagc

SEQ ID NO: 234 - DNA, 20 bp, Synthetic construct
  source 1..20: mol_type = other DNA
tgcctgtcctgcctagccca

SEQ ID NO: 235 - DNA, 20 bp, Synthetic construct
  source 1..20: mol_type = other DNA
tctgccactcacactcctca

SEQ ID NO: 236 - DNA, 20 bp, Synthetic construct
  source 1..20: mol_type = other DNA
ttctaatagccctttctccc

SEQ ID NO: 237 - DNA, 20 bp, Synthetic construct
  source 1..20: mol_type = other DNA
tcagcaagcgaatgaatgaa

SEQ ID NO: 238 - DNA, 20 bp, Synthetic construct
  source 1..20: mol_type = other DNA
gctgggacttttcccaacaa

SEQ ID NO: 239 - DNA, 20 bp, Synthetic construct
  source 1..20: mol_type = other DNA
aggccccgcctctagcccgg

SEQ ID NO: 240 - DNA, 20 bp, Synthetic construct
  source 1..20: mol_type = other DNA
tcatcaaacatctagtgact

SEQ ID NO: 241 - DNA, 20 bp, Synthetic construct
  source 1..20: mol_type = other DNA
tctatctgaaggaagatgga

SEQ ID NO: 242 - DNA, 20 bp, Synthetic construct
  source 1..20: mol_type = other DNA
gtgatcctgaaagaaagcag

SEQ ID NO: 243 - DNA, 20 bp, Synthetic construct
  source 1..20: mol_type = other DNA
tttagctcccccctcccccc

SEQ ID NO: 244 - DNA, 20 bp, Synthetic construct
  source 1..20: mol_type = other DNA
tgctttagtgacctgtgact

SEQ ID NO: 245 - DNA, 20 bp, Synthetic construct
  source 1..20: mol_type = other DNA
ctttcctgtcccctttcctc

SEQ ID NO: 246 - DNA, 20 bp, Synthetic construct
  source 1..20: mol_type = other DNA
agccaccaaccagccacatg

SEQ ID NO: 247 - DNA, 20 bp, Synthetic construct
  source 1..20: mol_type = other DNA
cctgtaatccccttactcgg

SEQ ID NO: 248 - DNA, 20 bp, Synthetic construct
  source 1..20: mol_type = other DNA
gctgccagagtcctggctgc

SEQ ID NO: 249 - DNA, 20 bp, Synthetic construct
  source 1..20: mol_type = other DNA
ccatcatgagtatgagaacc

SEQ ID NO: 250 - DNA, 20 bp, Synthetic construct
  source 1..20: mol_type = other DNA
gaggcctctcatggactttc

SEQ ID NO: 251 - DNA, 20 bp, Synthetic construct
  source 1..20: mol_type = other DNA
agccagagcctgactgggcc

SEQ ID NO: 252 - DNA, 20 bp, Synthetic construct
  source 1..20: mol_type = other DNA
ggaattacattcagtttcct

SEQ ID NO: 253 - DNA, 20 bp, Synthetic construct
  source 1..20: mol_type = other DNA
ctccccatccccaactgtgt

SEQ ID NO: 254 - DNA, 20 bp, Synthetic construct
  source 1..20: mol_type = other DNA
cgccaaatcccctcttccca

SEQ ID NO: 255 - DNA, 20 bp, Synthetic construct
  source 1..20: mol_type = other DNA
cccaggtcttacttttcttg

SEQ ID NO: 256 - DNA, 20 bp, Synthetic construct
  source 1..20: mol_type = other DNA
cgtctcctctccatcctgct

SEQ ID NO: 257 - DNA, 20 bp, Synthetic construct
  source 1..20: mol_type = other DNA
agacggcggccaggagccag

SEQ ID NO: 258 - DNA, 20 bp, Synthetic construct
  source 1..20: mol_type = other DNA
gagctccatcatctctgccc

SEQ ID NO: 259 - DNA, 20 bp, Synthetic construct
  source 1..20: mol_type = other DNA
cacagtggccaggtcctgtg

SEQ ID NO: 260 - DNA, 20 bp, Synthetic construct
  source 1..20: mol_type = other DNA
agggtggcttcatctgcttc

SEQ ID NO: 261 - DNA, 20 bp, Synthetic construct
  source 1..20: mol_type = other DNA
ggatcttcctcaagaaccgg

SEQ ID NO: 262 - DNA, 20 bp, Synthetic construct
  source 1..20: mol_type = other DNA
gagcggtaccactcttcggc

SEQ ID NO: 263 - DNA, 20 bp, Synthetic construct
  source 1..20: mol_type = other DNA
tgcccctcttcctccagccg

SEQ ID NO: 264 - DNA, 20 bp, Synthetic construct
  source 1..20: mol_type = other DNA
ggccttctgacacagacttg

SEQ ID NO: 265 - DNA, 20 bp, Synthetic construct
  source 1..20: mol_type = other DNA
taatgacctctccatcccgc

SEQ ID NO: 266 - DNA, 20 bp, Synthetic construct
  source 1..20: mol_type = other DNA
gtcctgcctcacatcacatc

SEQ ID NO: 267 - DNA, 20 bp, Synthetic construct
  source 1..20: mol_type = other DNA
cctgatactgacggagccta

SEQ ID NO: 268 - DNA, 20 bp, Synthetic construct
  source 1..20: mol_type = other DNA
ctcctcattctaacgcaagc

SEQ ID NO: 269 - DNA, 20 bp, Synthetic construct
  source 1..20: mol_type = other DNA
taggtgccccccgccctcct

SEQ ID NO: 270 - DNA, 20 bp, Synthetic construct
  source 1..20: mol_type = other DNA
acagttcccagatactccga

SEQ ID NO: 271 - DNA, 20 bp, Synthetic construct
  source 1..20: mol_type = other DNA
gtctcagttttcctccagca

SEQ ID NO: 272 - DNA, 20 bp, Synthetic construct
  source 1..20: mol_type = other DNA
ccaatctataatcccagcta

SEQ ID NO: 273 - DNA, 20 bp, Synthetic construct
  source 1..20: mol_type = other DNA
tgggcaggtgactgccccag

SEQ ID NO: 274 - DNA, 20 bp, Synthetic construct
  source 1..20: mol_type = other DNA
cagatcccccaagtgctgag

SEQ ID NO: 275 - DNA, 20 bp, Synthetic construct
  source 1..20: mol_type = other DNA
agcccccctctatccctccc

SEQ ID NO: 276 - DNA, 20 bp, Synthetic construct
  source 1..20: mol_type = other DNA
tgcctcctcctccatctcta

SEQ ID NO: 277 - DNA, 20 bp, Synthetic construct
  source 1..20: mol_type = other DNA
gcaactggtcacccacaacc

SEQ ID NO: 278 - DNA, 20 bp, Synthetic construct
  source 1..20: mol_type = other DNA
acatcccctttctctcctgt

SEQ ID NO: 279 - DNA, 20 bp, Synthetic construct
  source 1..20: mol_type = other DNA
tttgtgtgtgagtaagaagg

SEQ ID NO: 280 - DNA, 20 bp, Synthetic construct
  source 1..20: mol_type = other DNA
cctgagcacccggcctccag

SEQ ID NO: 281 - DNA, 20 bp, Synthetic construct
  source 1..20: mol_type = other DNA
tctgggcacagatcccacca

SEQ ID NO: 282 - DNA, 20 bp, Synthetic construct
  source 1..20: mol_type = other DNA
aggacccttcttcggcctta

SEQ ID NO: 283 - DNA, 20 bp, Synthetic construct
  source 1..20: mol_type = other DNA
tttatttttcctcagcgact

SEQ ID NO: 284 - DNA, 20 bp, Synthetic construct
  source 1..20: mol_type = other DNA
ccccctcgaatctgcaggtt

SEQ ID NO: 285 - DNA, 20 bp, Synthetic construct
  source 1..20: mol_type = other DNA
ttccatttacaatctggtga

SEQ ID NO: 286 - DNA, 20 bp, Synthetic construct
  source 1..20: mol_type = other DNA
gctctgccagtttaatgtac

SEQ ID NO: 287 - DNA, 20 bp, Synthetic construct
  source 1..20: mol_type = other DNA
actgcgcacccaaggactca

SEQ ID NO: 288 - DNA, 20 bp, Synthetic construct
  source 1..20: mol_type = other DNA
actttattcactgcaagagc

SEQ ID NO: 289 - DNA, 20 bp, Synthetic construct
  source 1..20: mol_type = other DNA
tgcccttcccacgaggccct

SEQ ID NO: 290 - DNA, 20 bp, Synthetic construct
  source 1..20: mol_type = other DNA
gccctgatcctcagtcccag

SEQ ID NO: 291 - DNA, 20 bp, Synthetic construct
  source 1..20: mol_type = other DNA
accctggtatgataggctct

SEQ ID NO: 292 - DNA, 20 bp, Synthetic construct
  source 1..20: mol_type = other DNA
ctcagggatctgcagacagg

SEQ ID NO: 293 - DNA, 20 bp, Synthetic construct
  source 1..20: mol_type = other DNA
atcccctcctcacttctgcc

SEQ ID NO: 294 - DNA, 20 bp, Synthetic construct
  source 1..20: mol_type = other DNA
gtccctcccatcatgttggg

SEQ ID NO: 295 - DNA, 20 bp, Synthetic construct
  source 1..20: mol_type = other DNA
gcccacagtcacaaagccca

SEQ ID NO: 296 - DNA, 20 bp, Synthetic construct
  source 1..20: mol_type = other DNA
tctccgcttccaactcctcc

SEQ ID NO: 297 - DNA, 20 bp, Synthetic construct
  source 1..20: mol_type = other DNA
accccagaatccaatctccc

SEQ ID NO: 298 - DNA, 20 bp, Synthetic construct
  source 1..20: mol_type = other DNA
accttttgaaatgaatttta

SEQ ID NO: 299 - DNA, 20 bp, Synthetic construct
  source 1..20: mol_type = other DNA
ctcctgcacttgaaggcaca

SEQ ID NO: 300 - DNA, 20 bp, Synthetic construct
  source 1..20: mol_type = other DNA
ttgccttaactcattactaa

SEQ ID NO: 301 - DNA, 20 bp, Synthetic construct
  source 1..20: mol_type = other DNA
tcacagagaccacccccacc

SEQ ID NO: 302 - DNA, 20 bp, Synthetic construct
  source 1..20: mol_type = other DNA
cctccctgacctgtctatag

SEQ ID NO: 303 - DNA, 20 bp, Synthetic construct
  source 1..20: mol_type = other DNA
tgccttacccctccttctgg

SEQ ID NO: 304 - DNA, 20 bp, Synthetic construct
  source 1..20: mol_type = other DNA
tctgccctggcctcacctcc

SEQ ID NO: 305 - DNA, 20 bp, Synthetic construct
  source 1..20: mol_type = other DNA
ttgtctttcatttcctgtct

SEQ ID NO: 306 - DNA, 20 bp, Synthetic construct
  source 1..20: mol_type = other DNA
ttcccgaacctcctgaccag

SEQ ID NO: 307 - DNA, 20 bp, Synthetic construct
  source 1..20: mol_type = other DNA
cccagcttcctccaccctcc

SEQ ID NO: 308 - DNA, 20 bp, Synthetic construct
  source 1..20: mol_type = other DNA
atcagctactactaataata

SEQ ID NO: 309 - DNA, 20 bp, Synthetic construct
  source 1..20: mol_type = other DNA
caactctaccacttaggagc

SEQ ID NO: 310 - DNA, 20 bp, Synthetic construct
  source 1..20: mol_type = other DNA
cagtaacccaaaacagactg

SEQ ID NO: 311 - DNA, 20 bp, Synthetic construct
  source 1..20: mol_type = other DNA
gctcccacactacatataag

SEQ ID NO: 312 - DNA, 20 bp, Synthetic construct
  source 1..20: mol_type = other DNA
cttctcttcctgtccacagc

SEQ ID NO: 313 - DNA, 20 bp, Synthetic construct
  source 1..20: mol_type = other DNA
ggcttctgccactcacactc

SEQ ID NO: 314 - DNA, 20 bp, Synthetic construct
  source 1..20: mol_type = other DNA
gttctaatagccctttctcc

SEQ ID NO: 315 - DNA, 20 bp, Synthetic construct
  source 1..20: mol_type = other DNA
gtcagcaagcgaatgaatga

SEQ ID NO: 316 - DNA, 20 bp, Synthetic construct
  source 1..20: mol_type = other DNA
cagcaccccagttaacccca

SEQ ID NO: 317 - DNA, 20 bp, Synthetic construct
  source 1..20: mol_type = other DNA
caggccccgcctctagcccg

SEQ ID NO: 318 - DNA, 20 bp, Synthetic construct
  source 1..20: mol_type = other DNA
ccattcagtcatcaaacatc

SEQ ID NO: 319 - DNA, 20 bp, Synthetic construct
  source 1..20: mol_type = other DNA
ggcgcatgtctatctgaagg

SEQ ID NO: 320 - DNA, 20 bp, Synthetic construct
  source 1..20: mol_type = other DNA
ggtgatcctgaaagaaagca

SEQ ID NO: 321 - DNA, 20 bp, Synthetic construct
  source 1..20: mol_type = other DNA
tgcaagtaaaaagtaattta

SEQ ID NO: 322 - DNA, 20 bp, Synthetic construct
  source 1..20: mol_type = other DNA
tgtgctttagtgacctgtga

SEQ ID NO: 323 - DNA, 20 bp, Synthetic construct
  source 1..20: mol_type = other DNA
ggtccctttcctgtcccctt

SEQ ID NO: 324 - DNA, 20 bp, Synthetic construct
  source 1..20: mol_type = other DNA
tagccaccaaccagccacat

SEQ ID NO: 325 - DNA, 20 bp, Synthetic construct
  source 1..20: mol_type = other DNA
acctgtaatccccttactcg

SEQ ID NO: 326 - DNA, 20 bp, Synthetic construct
  source 1..20: mol_type = other DNA
gtgctgctgccagagtcctg

SEQ ID NO: 327 - DNA, 20 bp, Synthetic construct
  source 1..20: mol_type = other DNA
ccccctccccatcatgagta

SEQ ID NO: 328 - DNA, 20 bp, Synthetic construct
  source 1..20: mol_type = other DNA
ggctggtttctgcagatgtg

SEQ ID NO: 329 - DNA, 20 bp, Synthetic construct
  source 1..20: mol_type = other DNA
cagccagagcctgactgggc

SEQ ID NO: 330 - DNA, 20 bp, Synthetic construct
  source 1..20: mol_type = other DNA
ggaaacggaattacattcag

SEQ ID NO: 331 - DNA, 20 bp, Synthetic construct
  source 1..20: mol_type = other DNA
cctccccatccccaactgtg

SEQ ID NO: 332 - DNA, 20 bp, Synthetic construct
  source 1..20: mol_type = other DNA
acgccaaatcccctcttccc

SEQ ID NO: 333 - DNA, 20 bp, Synthetic construct
  source 1..20: mol_type = other DNA
ccccgacttcccaggtctta

SEQ ID NO: 334 - DNA, 20 bp, Synthetic construct
  source 1..20: mol_type = other DNA
accatcatctcccctgagga

SEQ ID NO: 335 - DNA, 20 bp, Synthetic construct
  source 1..20: mol_type = other DNA
tgccaggacccagacggcgg

SEQ ID NO: 336 - DNA, 20 bp, Synthetic construct
  source 1..20: mol_type = other DNA
ttgagctccatcatctctgc

SEQ ID NO: 337 - DNA, 20 bp, Synthetic construct
  source 1..20: mol_type = other DNA
cctcacagtggccaggtcct

SEQ ID NO: 338 - DNA, 20 bp, Synthetic construct
  source 1..20: mol_type = other DNA
tcttcctctccagatccaga

SEQ ID NO: 339 - DNA, 20 bp, Synthetic construct
  source 1..20: mol_type = other DNA
tggatcttcctcaagaaccg

SEQ ID NO: 340 - DNA, 20 bp, Synthetic construct
  source 1..20: mol_type = other DNA
ggagcggtaccactcttcgg

SEQ ID NO: 341 - DNA, 20 bp, Synthetic construct
  source 1..20: mol_type = other DNA
gctctgcccctcttcctcca

SEQ ID NO: 342 - DNA, 20 bp, Synthetic construct
  source 1..20: mol_type = other DNA
tggccttctgacacagactt

SEQ ID NO: 343 - DNA, 20 bp, Synthetic construct
  source 1..20: mol_type = other DNA
ttaatgacctctccatcccg

SEQ ID NO: 344 - DNA, 20 bp, Synthetic construct
  source 1..20: mol_type = other DNA
gggtcctgcctcacatcaca

SEQ ID NO: 345 - DNA, 20 bp, Synthetic construct
  source 1..20: mol_type = other DNA
ggcctgatactgacggagcc

SEQ ID NO: 346 - DNA, 20 bp, Synthetic construct
  source 1..20: mol_type = other DNA
cctcctcattctaacgcaag

SEQ ID NO: 347 - DNA, 20 bp, Synthetic construct
  source 1..20: mol_type = other DNA
gtagtaggtgccccccgccc

SEQ ID NO: 348 - DNA, 20 bp, Synthetic construct
  source 1..20: mol_type = other DNA
cacagttcccagatactccg

SEQ ID NO: 349 - DNA, 20 bp, Synthetic construct
  source 1..20: mol_type = other DNA
agtctcagttttcctccagc

SEQ ID NO: 350 - DNA, 20 bp, Synthetic construct
  source 1..20: mol_type = other DNA
ggagaacaaccctctgagct

SEQ ID NO: 351 - DNA, 20 bp, Synthetic construct
  source 1..20: mol_type = other DNA
cacttgagtcatcgctcagg

SEQ ID NO: 352 - DNA, 20 bp, Synthetic construct
  source 1..20: mol_type = other DNA
acagatcccccaagtgctga

SEQ ID NO: 353 - DNA, 20 bp, Synthetic construct
  source 1..20: mol_type = other DNA
cagcccccctctatccctcc

SEQ ID NO: 354 - DNA, 20 bp, Synthetic construct
  source 1..20: mol_type = other DNA
attgcctcctcctccatctc

SEQ ID NO: 355 - DNA, 20 bp, Synthetic construct
  source 1..20: mol_type = other DNA
agaggccaagtgcaactggt

SEQ ID NO: 356 - DNA, 20 bp, Synthetic construct
  source 1..20: mol_type = other DNA
tacatcccctttctctcctg

SEQ ID NO: 357 - DNA, 20 bp, Synthetic construct
  source 1..20: mol_type = other DNA
cactacctagaatactgggt

SEQ ID NO: 358 - DNA, 20 bp, Synthetic construct
  source 1..20: mol_type = other DNA
cgtgtcagccctgagcaccc

SEQ ID NO: 359 - DNA, 20 bp, Synthetic construct
  source 1..20: mol_type = other DNA
ctctgggcacagatcccacc

SEQ ID NO: 360 - DNA, 20 bp, Synthetic construct
  source 1..20: mol_type = other DNA
ggaaggacccttcttcggcc

SEQ ID NO: 361 - DNA, 20 bp, Synthetic construct
  source 1..20: mol_type = other DNA
ctttatttttcctcagcgac

SEQ ID NO: 362 - DNA, 20 bp, Synthetic construct
  source 1..20: mol_type = other DNA
gccccctcgaatctgcaggt

SEQ ID NO: 363 - DNA, 20 bp, Synthetic construct
  source 1..20: mol_type = other DNA
gttccatttacaatctggtg

SEQ ID NO: 364 - DNA, 20 bp, Synthetic construct
  source 1..20: mol_type = other DNA
ttaccactaacaagctctgc

SEQ ID NO: 365 - DNA, 20 bp, Synthetic construct
  source 1..20: mol_type = other DNA
ccactgcgcacccaaggact

SEQ ID NO: 366 - DNA, 20 bp, Synthetic construct
  source 1..20: mol_type = other DNA
acataaaactttattcactg

SEQ ID NO: 367 - DNA, 20 bp, Synthetic construct
  source 1..20: mol_type = other DNA
gtgcccttcccacgaggccc

SEQ ID NO: 368 - DNA, 20 bp, Synthetic construct
  source 1..20: mol_type = other DNA
tgccctgatcctcagtccca

SEQ ID NO: 369 - DNA, 20 bp, Synthetic construct
  source 1..20: mol_type = other DNA
taccctggtatgataggctc

SEQ ID NO: 370 - DNA, 20 bp, Synthetic construct
  source 1..20: mol_type = other DNA
gtgcttgctcagggatctgc

SEQ ID NO: 371 - DNA, 20 bp, Synthetic construct
  source 1..20: mol_type = other DNA
ccatcccctcctcacttctg

SEQ ID NO: 372 - DNA, 20 bp, Synthetic construct
  source 1..20: mol_type = other DNA
ggtccctcccatcatgttgg

SEQ ID NO: 373 - DNA, 20 bp, Synthetic construct
  source 1..20: mol_type = other DNA
ctgcccacagtcacaaagcc

SEQ ID NO: 374 - DNA, 20 bp, Synthetic construct
  source 1..20: mol_type = other DNA
ttctccgcttccaactcctc

SEQ ID NO: 375 - DNA, 20 bp, Synthetic construct
  source 1..20: mol_type = other DNA
caccccagaatccaatctcc

SEQ ID NO: 376 - DNA, 20 bp, Synthetic construct
  source 1..20: mol_type = other DNA
aaccaccttttgaaatgaat

SEQ ID NO: 377 - DNA, 20 bp, Synthetic construct
  source 1..20: mol_type = other DNA
cacatgtcctcctgcacttg

SEQ ID NO: 378 - DNA, 20 bp, Synthetic construct
  source 1..20: mol_type = other DNA
tttgccttaactcattacta

SEQ ID NO: 379 - DNA, 20 bp, Synthetic construct
  source 1..20: mol_type = other DNA
gtcacagagaccacccccac

SEQ ID NO: 380 - DNA, 20 bp, Synthetic construct
  source 1..20: mol_type = other DNA
acctccctgacctgtctata

SEQ ID NO: 381 - DNA, 20 bp, Synthetic construct
  source 1..20: mol_type = other DNA
ttgccttacccctccttctg

SEQ ID NO: 382 - DNA, 20 bp, Synthetic construct
  source 1..20: mol_type = other DNA
agctttcctccctctgccct

SEQ ID NO: 383 - DNA, 20 bp, Synthetic construct
  source 1..20: mol_type = other DNA
gtttgtctttcatttcctgt

SEQ ID NO: 384 - DNA, 20 bp, Synthetic construct
  source 1..20: mol_type = other DNA
gttcccgaacctcctgacca

SEQ ID NO: 385 - DNA, 20 bp, Synthetic construct
  source 1..20: mol_type = other DNA
tcccagcttcctccaccctc

SEQ ID NO: 386 - DNA, 20 bp, Synthetic construct
  source 1..20: mol_type = other DNA
tatcagctactactaataat

SEQ ID NO: 387 - DNA, 20 bp, Synthetic construct
  source 1..20: mol_type = other DNA
ccaactctaccacttaggag

SEQ ID NO: 388 - DNA, 20 bp, Synthetic construct
  source 1..20: mol_type = other DNA
tcagtaacccaaaacagact

SEQ ID NO: 389 - DNA, 20 bp, Synthetic construct
  source 1..20: mol_type = other DNA
ggctcccacactacatataa

SEQ ID NO: 390 - DNA, 20 bp, Synthetic construct
  source 1..20: mol_type = other DNA
tcttctcttcctgtccacag

SEQ ID NO: 391 - DNA, 20 bp, Synthetic construct
  source 1..20: mol_type = other DNA
gtggcttctgccactcacac

SEQ ID NO: 392 - DNA, 20 bp, Synthetic construct
  source 1..20: mol_type = other DNA
ccctgggttctaatagccct

SEQ ID NO: 393 - DNA, 20 bp, Synthetic construct
  source 1..20: mol_type = other DNA
tggtcagcaagcgaatgaat

SEQ ID NO: 394 - DNA, 20 bp, Synthetic construct
  source 1..20: mol_type = other DNA
agcagcaccccagttaaccc

SEQ ID NO: 395 - DNA, 20 bp, Synthetic construct
  source 1..20: mol_type = other DNA
ccaggccccgcctctagccc

SEQ ID NO: 396 - DNA, 20 bp, Synthetic construct
  source 1..20: mol_type = other DNA
ccatccattcagtcatcaaa

SEQ ID NO: 397 - DNA, 20 bp, Synthetic construct
  source 1..20: mol_type = other DNA
ggcttgagtgttatctggga

SEQ ID NO: 398 - DNA, 20 bp, Synthetic construct
  source 1..20: mol_type = other DNA
atggtgatcctgaaagaaag

SEQ ID NO: 399 - DNA, 20 bp, Synthetic construct
  source 1..20: mol_type = other DNA
atgcaagtaaaaagtaattt

SEQ ID NO: 400 - DNA, 20 bp, Synthetic construct
  source 1..20: mol_type = other DNA
tctgccatttatctgtgctt

SEQ ID NO: 401 - DNA, 20 bp, Synthetic construct
  source 1..20: mol_type = other DNA
taggtccctttcctgtcccc

SEQ ID NO: 402 - DNA, 20 bp, Synthetic construct
  source 1..20: mol_type = other DNA
ttagccaccaaccagccaca

SEQ ID NO: 403 - DNA, 20 bp, Synthetic construct
  source 1..20: mol_type = other DNA
gcacctgtaatccccttact

SEQ ID NO: 404 - DNA, 20 bp, Synthetic construct
  source 1..20: mol_type = other DNA
agtgctgctgccagagtcct

SEQ ID NO: 405 - DNA, 20 bp, Synthetic construct
  source 1..20: mol_type = other DNA
cccccctccccatcatgagt

SEQ ID NO: 406 - DNA, 20 bp, Synthetic construct
  source 1..20: mol_type = other DNA
tacctctccatcccgcatct

SEQ ID NO: 407 - DNA, 20 bp, Synthetic construct
  source 1..20: mol_type = other DNA
tggccttgagaatccctggg

SEQ ID NO: 408 - DNA, 20 bp, Synthetic construct
  source 1..20: mol_type = other DNA
ctgaggaaacggaattacat

SEQ ID NO: 409 - DNA, 20 bp, Synthetic construct
  source 1..20: mol_type = other DNA
agccctccccatccccaact

SEQ ID NO: 410 - DNA, 20 bp, Synthetic construct
  source 1..20: mol_type = other DNA
tacgccaaatcccctcttcc

SEQ ID NO: 411 - DNA, 20 bp, Synthetic construct
  source 1..20: mol_type = other DNA
agtccccgacttcccaggtc

SEQ ID NO: 412 - DNA, 20 bp, Synthetic construct
  source 1..20: mol_type = other DNA
caccatcatctcccctgagg

SEQ ID NO: 413 - DNA, 20 bp, Synthetic construct
  source 1..20: mol_type = other DNA
gtgccaggacccagacggcg

SEQ ID NO: 414 - DNA, 20 bp, Synthetic construct
  source 1..20: mol_type = other DNA
cattgagctccatcatctct

SEQ ID NO: 415 - DNA, 20 bp, Synthetic construct
  source 1..20: mol_type = other DNA
tggtttcatcctggagcttc

SEQ ID NO: 416 - DNA, 20 bp, Synthetic construct
  source 1..20: mol_type = other DNA
aatcttcctctccagatcca

SEQ ID NO: 417 - DNA, 20 bp, Synthetic construct
  source 1..20: mol_type = other DNA
gtggatcttcctcaagaacc

SEQ ID NO: 418 - DNA, 20 bp, Synthetic construct
  source 1..20: mol_type = other DNA
tggagcggtaccactcttcg

SEQ ID NO: 419 - DNA, 20 bp, Synthetic construct
  source 1..20: mol_type = other DNA
aggctctgcccctcttcctc

SEQ ID NO: 420 - DNA, 20 bp, Synthetic construct
  source 1..20: mol_type = other DNA
ggtggccttctgacacagac

SEQ ID NO: 421 - DNA, 20 bp, Synthetic construct
  source 1..20: mol_type = other DNA
cttaatgacctctccatccc

SEQ ID NO: 422 - DNA, 20 bp, Synthetic construct
  source 1..20: mol_type = other DNA
tgggtcctgcctcacatcac

SEQ ID NO: 423 - DNA, 20 bp, Synthetic construct
  source 1..20: mol_type = other DNA
gcaggcctgatactgacgga

SEQ ID NO: 424 - DNA, 20 bp, Synthetic construct
  source 1..20: mol_type = other DNA
tcctcctcattctaacgcaa

SEQ ID NO: 425 - DNA, 20 bp, Synthetic construct
  source 1..20: mol_type = other DNA
gtggagggcgatgtagtagg

SEQ ID NO: 426 - DNA, 20 bp, Synthetic construct
  source 1..20: mol_type = other DNA
gcacagttcccagatactcc

SEQ ID NO: 427 - DNA, 20 bp, Synthetic construct
  source 1..20: mol_type = other DNA
cttccctttcctgtctgagt

SEQ ID NO: 428 - DNA, 20 bp, Synthetic construct
  source 1..20: mol_type = other DNA
tctaggagaacaaccctctg

SEQ ID NO: 429 - DNA, 20 bp, Synthetic construct
  source 1..20: mol_type = other DNA
gacacttgagtcatcgctca

SEQ ID NO: 430 - DNA, 20 bp, Synthetic construct
  source 1..20: mol_type = other DNA
aacagatcccccaagtgctg

SEQ ID NO: 431 - DNA, 20 bp, Synthetic construct
  source 1..20: mol_type = other DNA
gcagcccccctctatccctc

SEQ ID NO: 432 - DNA, 20 bp, Synthetic construct
  source 1..20: mol_type = other DNA
cccaattgcctcctcctcca

SEQ ID NO: 433 - DNA, 20 bp, Synthetic construct
  source 1..20: mol_type = other DNA
ttcccacaatccagaggcca

SEQ ID NO: 434 - DNA, 20 bp, Synthetic construct
  source 1..20: mol_type = other DNA
atacatcccctttctctcct

SEQ ID NO: 435 - DNA, 20 bp, Synthetic construct
  source 1..20: mol_type = other DNA
ggcactacctagaatactgg

SEQ ID NO: 436 - DNA, 20 bp, Synthetic construct
  source 1..20: mol_type = other DNA
gtctgctcagtcaaagcaga

SEQ ID NO: 437 - DNA, 20 bp, Synthetic construct
  source 1..20: mol_type = other DNA
cccagtcccatctctgggca

SEQ ID NO: 438 - DNA, 20 bp, Synthetic construct
  source 1..20: mol_type = other DNA
gggaaggacccttcttcggc

SEQ ID NO: 439 - DNA, 20 bp, Synthetic construct
  source 1..20: mol_type = other DNA
tctttatttttcctcagcga

SEQ ID NO: 440 - DNA, 20 bp, Synthetic construct
  source 1..20: mol_type = other DNA
ttgccccctcgaatctgcag

SEQ ID NO: 441 - DNA, 20 bp, Synthetic construct
  source 1..20: mol_type = other DNA
cgttccatttacaatctggt

SEQ ID NO: 442 - DNA, 20 bp, Synthetic construct
  source 1..20: mol_type = other DNA
cctttaccactaacaagctc

SEQ ID NO: 443 - DNA, 20 bp, Synthetic construct
  source 1..20: mol_type = other DNA
cagctccactgcgcacccaa

SEQ ID NO: 444 - DNA, 20 bp, Synthetic construct
  source 1..20: mol_type = other DNA
agagcagggaacataaaact

SEQ ID NO: 445 - DNA, 20 bp, Synthetic construct
  source 1..20: mol_type = other DNA
agtgcccttcccacgaggcc

SEQ ID NO: 446 - DNA, 20 bp, Synthetic construct
  source 1..20: mol_type = other DNA
ttgccctgatcctcagtccc

SEQ ID NO: 447 - DNA, 20 bp, Synthetic construct
  source 1..20: mol_type = other DNA
ccacctagaagtaccctggt

SEQ ID NO: 448 - DNA, 20 bp, Synthetic construct
  source 1..20: mol_type = other DNA
gaaaacactcagaagggcag

SEQ ID NO: 449 - DNA, 20 bp, Synthetic construct
  source 1..20: mol_type = other DNA
cccatcccctcctcacttct

SEQ ID NO: 450 - DNA, 20 bp, Synthetic construct
  source 1..20: mol_type = other DNA
ctggtccctcccatcatgtt

SEQ ID NO: 451 - DNA, 20 bp, Synthetic construct
  source 1..20: mol_type = other DNA
gctgcccacagtcacaaagc

SEQ ID NO: 452 - DNA, 20 bp, Synthetic construct
  source 1..20: mol_type = other DNA
tcaaccttctccgcttccaa

SEQ ID NO: 453 - DNA, 20 bp, Synthetic construct
  source 1..20: mol_type = other DNA
ttcttcaccccagaatccaa

SEQ ID NO: 454 - DNA, 20 bp, Synthetic construct
  source 1..20: mol_type = other DNA
taaccaccttttgaaatgaa

SEQ ID NO: 455 - DNA, 20 bp, Synthetic construct
  source 1..20: mol_type = other DNA
ctgctcacacaggcgcatcc

SEQ ID NO: 456 - DNA, 20 bp, Synthetic construct
  source 1..20: mol_type = other DNA
ttttgccttaactcattact

SEQ ID NO: 457 - DNA, 20 bp, Synthetic construct
  source 1..20: mol_type = other DNA
tgtcacagagaccaccccca

SEQ ID NO: 458 - DNA, 20 bp, Synthetic construct
  source 1..20: mol_type = other DNA
tccacctccctgacctgtct

SEQ ID NO: 459 - DNA, 20 bp, Synthetic construct
  source 1..20: mol_type = other DNA
gccttgccttacccctcctt

SEQ ID NO: 460 - DNA, 20 bp, Synthetic construct
  source 1..20: mol_type = other DNA
tgagctttcctccctctgcc

SEQ ID NO: 461 - DNA, 20 bp, Synthetic construct
  source 1..20: mol_type = other DNA
tagtgtctttctgtttgtct

SEQ ID NO: 462 - DNA, 20 bp, Synthetic construct
  source 1..20: mol_type = other DNA
agttcccgaacctcctgacc

SEQ ID NO: 463 - DNA, 20 bp, Synthetic construct
  source 1..20: mol_type = other DNA
ctcccagcttcctccaccct

SEQ ID NO: 464 - DNA, 20 bp, Synthetic construct
  source 1..20: mol_type = other DNA
gtatcagctactactaataa

SEQ ID NO: 465 - DNA, 20 bp, Synthetic construct
  source 1..20: mol_type = other DNA
tccaactctaccacttagga

SEQ ID NO: 466 - DNA, 20 bp, Synthetic construct
  source 1..20: mol_type = other DNA
ctcagtaacccaaaacagac

SEQ ID NO: 467 - DNA, 20 bp, Synthetic construct
  source 1..20: mol_type = other DNA
ctggctcccacactacatat

SEQ ID NO: 468 - DNA, 20 bp, Synthetic construct
  source 1..20: mol_type = other DNA
ttcttctcttcctgtccaca

SEQ ID NO: 469 - DNA, 20 bp, Synthetic construct
  source 1..20: mol_type = other DNA
agtggcttctgccactcaca

SEQ ID NO: 470 - DNA, 20 bp, Synthetic construct
  source 1..20: mol_type = other DNA
accctgggttctaatagccc

SEQ ID NO: 471 - DNA, 20 bp, Synthetic construct
  source 1..20: mol_type = other DNA
acctagcacaacacctggtc

SEQ ID NO: 472 - DNA, 20 bp, Synthetic construct
  source 1..20: mol_type = other DNA
gcgctcaccgtgccgcgcag

SEQ ID NO: 473 - DNA, 20 bp, Synthetic construct
  source 1..20: mol_type = other DNA
gagccccgacccgacttggg

SEQ ID NO: 474 - DNA, 20 bp, Synthetic construct
  source 1..20: mol_type = other DNA
gttgaatccatccatccatt

SEQ ID NO: 475 - DNA, 20 bp, Synthetic construct
  source 1..20: mol_type = other DNA
agctttttccccagcagcca

SEQ ID NO: 476 - DNA, 20 bp, Synthetic construct
  source 1..20: mol_type = other DNA
aatggtgatcctgaaagaaa

SEQ ID NO: 477 - DNA, 20 bp, Synthetic construct
  source 1..20: mol_type = other DNA
agctaagaatcatttcaggg

SEQ ID NO: 478 - DNA, 20 bp, Synthetic construct
  source 1..20: mol_type = other DNA
ctctctgccatttatctgtg

SEQ ID NO: 479 - DNA, 20 bp, Synthetic construct
  source 1..20: mol_type = other DNA
ataggtccctttcctgtccc

SEQ ID NO: 480 - DNA, 20 bp, Synthetic construct
  source 1..20: mol_type = other DNA
cttagccaccaaccagccac

SEQ ID NO: 481 - DNA, 20 bp, Synthetic construct
  source 1..20: mol_type = other DNA
cgcacctgtaatccccttac

SEQ ID NO: 482 - DNA, 20 bp, Synthetic construct
  source 1..20: mol_type = other DNA
atcccaatagtgctgctgcc

SEQ ID NO: 483 - DNA, 20 bp, Synthetic construct
  source 1..20: mol_type = other DNA
cgcacccccctccccatcat

SEQ ID NO: 484 - DNA, 20 bp, Synthetic construct
  source 1..20: mol_type = other DNA
tccttacctctccatcccgc

SEQ ID NO: 485 - DNA, 20 bp, Synthetic construct
  source 1..20: mol_type = other DNA
ggctttcctccatggcctgg

SEQ ID NO: 486 - DNA, 20 bp, Synthetic construct
  source 1..20: mol_type = other DNA
gactgaggaaacggaattac

SEQ ID NO: 487 - DNA, 20 bp, Synthetic construct
  source 1..20: mol_type = other DNA
atggaaagccctccccatcc

SEQ ID NO: 488 - DNA, 20 bp, Synthetic construct
  source 1..20: mol_type = other DNA
atacgccaaatcccctcttc

SEQ ID NO: 489 - DNA, 20 bp, Synthetic construct
  source 1..20: mol_type = other DNA
aagtccccgacttcccaggt

SEQ ID NO: 490 - DNA, 20 bp, Synthetic construct
  source 1..20: mol_type = other DNA
cccaccatcatctcccctga

SEQ ID NO: 491 - DNA, 20 bp, Synthetic construct
  source 1..20: mol_type = other DNA
ggcgggtgccaggacccaga

SEQ ID NO: 492 - DNA, 20 bp, Synthetic construct
  source 1..20: mol_type = other DNA
agctggttcagctcagcagc

SEQ ID NO: 493 - DNA, 20 bp, Synthetic construct
  source 1..20: mol_type = other DNA
ggttggtttcatcctggagc

SEQ ID NO: 494 - DNA, 20 bp, Synthetic construct
  source 1..20: mol_type = other DNA
tcaatcttcctctccagatc

SEQ ID NO: 495 - DNA, 20 bp, Synthetic construct
  source 1..20: mol_type = other DNA
gagttcccgaacctcctcct

SEQ ID NO: 496 - DNA, 20 bp, Synthetic construct
  source 1..20: mol_type = other DNA
aggtctgcaaacttggagcg

SEQ ID NO: 497 - DNA, 20 bp, Synthetic construct
  source 1..20: mol_type = other DNA
cttgaggctctgcccctctt

SEQ ID NO: 498 - DNA, 20 bp, Synthetic construct
  source 1..20: mol_type = other DNA
aggtggccttctgacacaga

SEQ ID NO: 499 - DNA, 20 bp, Synthetic construct
  source 1..20: mol_type = other DNA
ccttaatgacctctccatcc

SEQ ID NO: 500 - DNA, 20 bp, Synthetic construct
  source 1..20: mol_type = other DNA
gtgggtcctgcctcacatca

SEQ ID NO: 501 - DNA, 20 bp, Synthetic construct
  source 1..20: mol_type = other DNA
ggcaggcctgatactgacgg

SEQ ID NO: 502 - DNA, 20 bp, Synthetic construct
  source 1..20: mol_type = other DNA
ttcctcctcattctaacgca

SEQ ID NO: 503 - DNA, 20 bp, Synthetic construct
  source 1..20: mol_type = other DNA
tgtggagggcgatgtagtag

SEQ ID NO: 504 - DNA, 20 bp, Synthetic construct
  source 1..20: mol_type = other DNA
ggcacagttcccagatactc

SEQ ID NO: 505 - DNA, 20 bp, Synthetic construct
  source 1..20: mol_type = other DNA
ccttccctttcctgtctgag

SEQ ID NO: 506 - DNA, 20 bp, Synthetic construct
  source 1..20: mol_type = other DNA
gtctaggagaacaaccctct

SEQ ID NO: 507 - DNA, 20 bp, Synthetic construct
  source 1..20: mol_type = other DNA
gtggactgagacacttgagt

SEQ ID NO: 508 - DNA, 20 bp, Synthetic construct
  source 1..20: mol_type = other DNA
cgtacacaacagatccccca

SEQ ID NO: 509 - DNA, 20 bp, Synthetic construct
  source 1..20: mol_type = other DNA
ggcagcccccctctatccct

SEQ ID NO: 510 - DNA, 20 bp, Synthetic construct
  source 1..20: mol_type = other DNA
tcccaattgcctcctcctcc

SEQ ID NO: 511 - DNA, 20 bp, Synthetic construct
  source 1..20: mol_type = other DNA
ccttaattcccacaatccag

SEQ ID NO: 512 - DNA, 20 bp, Synthetic construct
  source 1..20: mol_type = other DNA
gatacatcccctttctctcc

SEQ ID NO: 513 - DNA, 20 bp, Synthetic construct
  source 1..20: mol_type = other DNA
gggcactacctagaatactg

SEQ ID NO: 514 - DNA, 20 bp, Synthetic construct
  source 1..20: mol_type = other DNA
ctgctcaccagtctgctcag

SEQ ID NO: 515 - DNA, 20 bp, Synthetic construct
  source 1..20: mol_type = other DNA
tcccagtcccatctctgggc

SEQ ID NO: 516 - DNA, 20 bp, Synthetic construct
  source 1..20: mol_type = other DNA
agggaaggacccttcttcgg

SEQ ID NO: 517 - DNA, 20 bp, Synthetic construct
  source 1..20: mol_type = other DNA
gtctttatttttcctcagcg

SEQ ID NO: 518 - DNA, 20 bp, Synthetic construct
  source 1..20: mol_type = other DNA
tgcttttgccccctcgaatc

SEQ ID NO: 519 - DNA, 20 bp, Synthetic construct
  source 1..20: mol_type = other DNA
gcagctaaccgcgagccggc

SEQ ID NO: 520 - DNA, 20 bp, Synthetic construct
  source 1..20: mol_type = other DNA
acctttaccactaacaagct

SEQ ID NO: 521 - DNA, 20 bp, Synthetic construct
  source 1..20: mol_type = other DNA
agcagctccactgcgcaccc

SEQ ID NO: 522 - DNA, 20 bp, Synthetic construct
  source 1..20: mol_type = other DNA
atttaacattaagagcaggg

SEQ ID NO: 523 - DNA, 20 bp, Synthetic construct
  source 1..20: mol_type = other DNA
cagtgcccttcccacgaggc

SEQ ID NO: 524 - DNA, 20 bp, Synthetic construct
  source 1..20: mol_type = other DNA
cctttgccctgatcctcagt

SEQ ID NO: 525 - DNA, 20 bp, Synthetic construct
  source 1..20: mol_type = other DNA
ccccacctagaagtaccctg

SEQ ID NO: 526 - DNA, 20 bp, Synthetic construct
  source 1..20: mol_type = other DNA
agaaaacactcagaagggca

SEQ ID NO: 527 - DNA, 20 bp, Synthetic construct
  source 1..20: mol_type = other DNA
ccccatcccctcctcacttc

SEQ ID NO: 528 - DNA, 20 bp, Synthetic construct
  source 1..20: mol_type = other DNA
ttctggtccctcccatcatg

SEQ ID NO: 529 - DNA, 20 bp, Synthetic construct
  source 1..20: mol_type = other DNA
gctcgctgcccacagtcaca

SEQ ID NO: 530 - DNA, 20 bp, Synthetic construct
  source 1..20: mol_type = other DNA
gacatcaaccttctccgctt

SEQ ID NO: 531 - DNA, 20 bp, Synthetic construct
  source 1..20: mol_type = other DNA
ctcactttcttcaccccaga

SEQ ID NO: 532 - DNA, 20 bp, Synthetic construct
  source 1..20: mol_type = other DNA
ggtaaccaccttttgaaatg

SEQ ID NO: 533 - DNA, 20 bp, Synthetic construct
  source 1..20: mol_type = other DNA
ttctgctcacacaggcgcat

SEQ ID NO: 534 - DNA, 20 bp, Synthetic construct
  source 1..20: mol_type = other DNA
ggcttttgccttaactcatt

SEQ ID NO: 535 - DNA, 20 bp, Synthetic construct
  source 1..20: mol_type = other DNA
gctgtcacagagaccacccc

SEQ ID NO: 536 - DNA, 20 bp, Synthetic construct
  source 1..20: mol_type = other DNA
ccctccacctccctgacctg

SEQ ID NO: 537 - DNA, 20 bp, Synthetic construct
  source 1..20: mol_type = other DNA
cagccttgccttacccctcc

SEQ ID NO: 538 - DNA, 20 bp, Synthetic construct
  source 1..20: mol_type = other DNA
ttgagctttcctccctctgc

SEQ ID NO: 539 - DNA, 20 bp, Synthetic construct
  source 1..20: mol_type = other DNA
ttccgtctcccttagtgtct

SEQ ID NO: 540 - DNA, 20 bp, Synthetic construct
  source 1..20: mol_type = other DNA
gagttcccgaacctcctgac

SEQ ID NO: 541 - DNA, 20 bp, Synthetic construct
  source 1..20: mol_type = other DNA
ggatattctcccagcttcct

SEQ ID NO: 542 - DNA, 20 bp, Synthetic construct
  source 1..20: mol_type = other DNA
agaacagtatcagctactac

SEQ ID NO: 543 - DNA, 20 bp, Synthetic construct
  source 1..20: mol_type = other DNA
ggaaatccaactctaccact

SEQ ID NO: 544 - DNA, 20 bp, Synthetic construct
  source 1..20: mol_type = other DNA
gctcagtaacccaaaacaga

SEQ ID NO: 545 - DNA, 20 bp, Synthetic construct
  source 1..20: mol_type = other DNA
cctggctcccacactacata

SEQ ID NO: 546 - DNA, 20 bp, Synthetic construct
  source 1..20: mol_type = other DNA
ccttcttctcttcctgtcca

SEQ ID NO: 547 - DNA, 20 bp, Synthetic construct
  source 1..20: mol_type = other DNA
tgctcagacaccagtggctt

SEQ ID NO: 548 - DNA, 20 bp, Synthetic construct
  source 1..20: mol_type = other DNA
gcctggcctcaccctgggtt

SEQ ID NO: 549 - DNA, 20 bp, Synthetic construct
  source 1..20: mol_type = other DNA
ctgccagacctcagcaccta

SEQ ID NO: 550 - DNA, 20 bp, Synthetic construct
  source 1..20: mol_type = other DNA
ggccgcgctcaccgtgccgc

SEQ ID NO: 551 - DNA, 20 bp, Synthetic construct
  source 1..20: mol_type = other DNA
ggagccccgacccgacttgg

SEQ ID NO: 552 - DNA, 20 bp, Synthetic construct
  source 1..20: mol_type = other DNA
ggttgaatccatccatccat

SEQ ID NO: 553 - DNA, 20 bp, Synthetic construct
  source 1..20: mol_type = other DNA
tagctttttccccagcagcc

SEQ ID NO: 554 - DNA, 20 bp, Synthetic construct
  source 1..20: mol_type = other DNA
gaatggtgatcctgaaagaa

SEQ ID NO: 555 - DNA, 20 bp, Synthetic construct
  source 1..20: mol_type = other DNA
agtggtcctaaatattctag

SEQ ID NO: 556 - DNA, 20 bp, Synthetic construct
  source 1..20: mol_type = other DNA
tctctctgccatttatctgt

SEQ ID NO: 557 - DNA, 20 bp, Synthetic construct
  source 1..20: mol_type = other DNA
cataggtccctttcctgtcc

SEQ ID NO: 558 - DNA, 20 bp, Synthetic construct
  source 1..20: mol_type = other DNA
caacttagccaccaaccagc

SEQ ID NO: 559 - DNA, 20 bp, Synthetic construct
  source 1..20: mol_type = other DNA
ggctttctgaaaacccagca

SEQ ID NO: 560 - DNA, 20 bp, Synthetic construct
  source 1..20: mol_type = other DNA
cccccaaatcccaatagtgc

SEQ ID NO: 561 - DNA, 20 bp, Synthetic construct
  source 1..20: mol_type = other DNA
tcgcacccccctccccatca

SEQ ID NO: 562 - DNA, 20 bp, Synthetic construct
  source 1..20: mol_type = other DNA
ctccttacctctccatcccg

SEQ ID NO: 563 - DNA, 20 bp, Synthetic construct
  source 1..20: mol_type = other DNA
aggctttcctccatggcctg

SEQ ID NO: 564 - DNA, 20 bp, Synthetic construct
  source 1..20: mol_type = other DNA
tagaacagcctatggaggga

SEQ ID NO: 565 - DNA, 20 bp, Synthetic construct
  source 1..20: mol_type = other DNA
gtttccttttaccaagctgg

SEQ ID NO: 566 - DNA, 20 bp, Synthetic construct
  source 1..20: mol_type = other DNA
gatacgccaaatcccctctt

SEQ ID NO: 567 - DNA, 20 bp, Synthetic construct
  source 1..20: mol_type = other DNA
gggaagtccccgacttccca

SEQ ID NO: 568 - DNA, 20 bp, Synthetic construct
  source 1..20: mol_type = other DNA
ccccaccatcatctcccctg

SEQ ID NO: 569 - DNA, 20 bp, Synthetic construct
  source 1..20: mol_type = other DNA
cattcgagccagggagaggc

SEQ ID NO: 570 - DNA, 20 bp, Synthetic construct
  source 1..20: mol_type = other DNA
gctccttggcccgcagctgg

SEQ ID NO: 571 - DNA, 20 bp, Synthetic construct
  source 1..20: mol_type = other DNA
aggttggtttcatcctggag

SEQ ID NO: 572 - DNA, 20 bp, Synthetic construct
  source 1..20: mol_type = other DNA
ctcaatcttcctctccagat

SEQ ID NO: 573 - DNA, 20 bp, Synthetic construct
  source 1..20: mol_type = other DNA
ctggagttcccgaacctcct

SEQ ID NO: 574 - DNA, 20 bp, Synthetic construct
  source 1..20: mol_type = other DNA
agagactccaggtcgcaggt

SEQ ID NO: 575 - DNA, 20 bp, Synthetic construct
  source 1..20: mol_type = other DNA
cctggtactcctgcaagtgg

SEQ ID NO: 576 - DNA, 20 bp, Synthetic construct
  source 1..20: mol_type = other DNA
tgaggtggccttctgacaca

SEQ ID NO: 577 - DNA, 20 bp, Synthetic construct
  source 1..20: mol_type = other DNA
ggactccttaatgacctctc

SEQ ID NO: 578 - DNA, 20 bp, Synthetic construct
  source 1..20: mol_type = other DNA
agaggccaccaggtgggtcc

SEQ ID NO: 579 - DNA, 20 bp, Synthetic construct
  source 1..20: mol_type = other DNA
tggcaggcctgatactgacg

SEQ ID NO: 580 - DNA, 20 bp, Synthetic construct
  source 1..20: mol_type = other DNA
cttcctcctcattctaacgc

SEQ ID NO: 581 - DNA, 20 bp, Synthetic construct
  source 1..20: mol_type = other DNA
acagtttccataacaacagg

SEQ ID NO: 582 - DNA, 20 bp, Synthetic construct
  source 1..20: mol_type = other DNA
aaaggcacagttcccagata

SEQ ID NO: 583 - DNA, 20 bp, Synthetic construct
  source 1..20: mol_type = other DNA
gccttccctttcctgtctga

SEQ ID NO: 584 - DNA, 20 bp, Synthetic construct
  source 1..20: mol_type = other DNA
agtctaggagaacaaccctc

SEQ ID NO: 585 - DNA, 20 bp, Synthetic construct
  source 1..20: mol_type = other DNA
gatggcatccctggatggca

SEQ ID NO: 586 - DNA, 20 bp, Synthetic construct
  source 1..20: mol_type = other DNA
gcacctcatccctctccacg

SEQ ID NO: 587 - DNA, 20 bp, Synthetic construct
  source 1..20: mol_type = other DNA
aggcagcccccctctatccc

SEQ ID NO: 588 - DNA, 20 bp, Synthetic construct
  source 1..20: mol_type = other DNA
atcccaattgcctcctcctc

SEQ ID NO: 589 - DNA, 20 bp, Synthetic construct
  source 1..20: mol_type = other DNA
tccttaattcccacaatcca

SEQ ID NO: 590 - DNA, 20 bp, Synthetic construct
  source 1..20: mol_type = other DNA
ggatacatcccctttctctc

SEQ ID NO: 591 - DNA, 20 bp, Synthetic construct
  source 1..20: mol_type = other DNA
gcctcagttttacaattgta

SEQ ID NO: 592 - DNA, 20 bp, Synthetic construct
  source 1..20: mol_type = other DNA
tctgctcaccagtctgctca

SEQ ID NO: 593 - DNA, 20 bp, Synthetic construct
  source 1..20: mol_type = other DNA
cctcccagtcccatctctgg

SEQ ID NO: 594 - DNA, 20 bp, Synthetic construct
  source 1..20: mol_type = other DNA
ggagagggaaggacccttct

SEQ ID NO: 595 - DNA, 20 bp, Synthetic construct
  source 1..20: mol_type = other DNA
tgtctttatttttcctcagc

SEQ ID NO: 596 - DNA, 20 bp, Synthetic construct
  source 1..20: mol_type = other DNA
ggtgcttttgccccctcgaa

SEQ ID NO: 597 - DNA, 20 bp, Synthetic construct
  source 1..20: mol_type = other DNA
ggcagctaaccgcgagccgg

SEQ ID NO: 598 - DNA, 20 bp, Synthetic construct
  source 1..20: mol_type = other DNA
cacctttaccactaacaagc

SEQ ID NO: 599 - DNA, 20 bp, Synthetic construct
  source 1..20: mol_type = other DNA
gagcagctccactgcgcacc

SEQ ID NO: 600 - DNA, 20 bp, Synthetic construct
  source 1..20: mol_type = other DNA
tatttaacattaagagcagg

SEQ ID NO: 601 - DNA, 20 bp, Synthetic construct
  source 1..20: mol_type = other DNA
ccagtgcccttcccacgagg

SEQ ID NO: 602 - DNA, 20 bp, Synthetic construct
  source 1..20: mol_type = other DNA
tccctttgccctgatcctca

SEQ ID NO: 603 - DNA, 20 bp, Synthetic construct
  source 1..20: mol_type = other DNA
agccccacctagaagtaccc

SEQ ID NO: 604 - DNA, 20 bp, Synthetic construct
  source 1..20: mol_type = other DNA
cagaaaacactcagaagggc

SEQ ID NO: 605 - DNA, 20 bp, Synthetic construct
  source 1..20: mol_type = other DNA
tccccatcccctcctcactt

SEQ ID NO: 606 - DNA, 20 bp, Synthetic construct
  source 1..20: mol_type = other DNA
gtttctggtccctcccatca

SEQ ID NO: 607 - DNA, 20 bp, Synthetic construct
  source 1..20: mol_type = other DNA
agctcgctgcccacagtcac

SEQ ID NO: 608 - DNA, 20 bp, Synthetic construct
  source 1..20: mol_type = other DNA
ggacatcaaccttctccgct

SEQ ID NO: 609 - DNA, 20 bp, Synthetic construct
  source 1..20: mol_type = other DNA
cctcactttcttcaccccag

SEQ ID NO: 610 - DNA, 20 bp, Synthetic construct
  source 1..20: mol_type = other DNA
caggtaaccaccttttgaaa

SEQ ID NO: 611 - DNA, 20 bp, Synthetic construct
  source 1..20: mol_type = other DNA
gcttctgctcacacaggcgc

SEQ ID NO: 612 - DNA, 20 bp, Synthetic construct
  source 1..20: mol_type = other DNA
gggcttttgccttaactcat

SEQ ID NO: 613 - DNA, 20 bp, Synthetic construct
  source 1..20: mol_type = other DNA
tcagtctcccttgaggcagc

SEQ ID NO: 614 - DNA, 20 bp, Synthetic construct
  source 1..20: mol_type = other DNA
cccctccacctccctgacct

SEQ ID NO: 615 - DNA, 20 bp, Synthetic construct
  source 1..20: mol_type = other DNA
tcagccttgccttacccctc

SEQ ID NO: 616 - DNA, 20 bp, Synthetic construct
  source 1..20: mol_type = other DNA
gttgagctttcctccctctg

SEQ ID NO: 617 - DNA, 20 bp, Synthetic construct
  source 1..20: mol_type = other DNA
tctctttccgtctcccttag

SEQ ID NO: 618 - DNA, 20 bp, Synthetic construct
  source 1..20: mol_type = other DNA
ggcagggctaccttggagcg

SEQ ID NO: 619 - DNA, 20 bp, Synthetic construct
  source 1..20: mol_type = other DNA
aggatattctcccagcttcc

SEQ ID NO: 620 - DNA, 20 bp, Synthetic construct
  source 1..20: mol_type = other DNA
cagaacagtatcagctacta

SEQ ID NO: 621 - DNA, 20 bp, Synthetic construct
  source 1..20: mol_type = other DNA
tggaaatccaactctaccac

SEQ ID NO: 622 - DNA, 20 bp, Synthetic construct
  source 1..20: mol_type = other DNA
ggctcagtaacccaaaacag

SEQ ID NO: 623 - DNA, 20 bp, Synthetic construct
  source 1..20: mol_type = other DNA
ttcctggctcccacactaca

SEQ ID NO: 624 - DNA, 20 bp, Synthetic construct
  source 1..20: mol_type = other DNA
gccctcccttcttctcttcc

SEQ ID NO: 625 - DNA, 20 bp, Synthetic construct
  source 1..20: mol_type = other DNA
ctgctcagacaccagtggct

SEQ ID NO: 626 - DNA, 20 bp, Synthetic construct
  source 1..20: mol_type = other DNA
tcgcctggcctcaccctggg

SEQ ID NO: 627 - DNA, 20 bp, Synthetic construct
  source 1..20: mol_type = other DNA
gctgccagacctcagcacct

SEQ ID NO: 628 - DNA, 20 bp, Synthetic construct
  source 1..20: mol_type = other DNA
tgccctggccgcgctcaccg

SEQ ID NO: 629 - DNA, 20 bp, Synthetic construct
  source 1..20: mol_type = other DNA
ccgcggagccccgacccgac

SEQ ID NO: 630 - DNA, 20 bp, Synthetic construct
  source 1..20: mol_type = other DNA
tggttgaatccatccatcca

SEQ ID NO: 631 - DNA, 20 bp, Synthetic construct
  source 1..20: mol_type = other DNA
ctagctttttccccagcagc

SEQ ID NO: 632 - DNA, 20 bp, Synthetic construct
  source 1..20: mol_type = other DNA
ctaatatttaacattaagag

SEQ ID NO: 633 - DNA, 20 bp, Synthetic construct
  source 1..20: mol_type = other DNA
tagtggtcctaaatattcta

SEQ ID NO: 634 - DNA, 20 bp, Synthetic construct
  source 1..20: mol_type = other DNA
ttctctctgccatttatctg

SEQ ID NO: 635 - DNA, 20 bp, Synthetic construct
  source 1..20: mol_type = other DNA
cacataggtccctttcctgt

SEQ ID NO: 636 - DNA, 20 bp, Synthetic construct
  source 1..20: mol_type = other DNA
ccaacttagccaccaaccag

SEQ ID NO: 637 - DNA, 20 bp, Synthetic construct
  source 1..20: mol_type = other DNA
tggctttctgaaaacccagc

SEQ ID NO: 638 - DNA, 20 bp, Synthetic construct
  source 1..20: mol_type = other DNA
gcccccaaatcccaatagtg

SEQ ID NO: 639 - DNA, 20 bp, Synthetic construct
  source 1..20: mol_type = other DNA
atcgcacccccctccccatc

SEQ ID NO: 640 - DNA, 20 bp, Synthetic construct
  source 1..20: mol_type = other DNA
ccctccttacctctccatcc

SEQ ID NO: 641 - DNA, 20 bp, Synthetic construct
  source 1..20: mol_type = other DNA
ccaggctttcctccatggcc

SEQ ID NO: 642 - DNA, 20 bp, Synthetic construct
  source 1..20: mol_type = other DNA
ttagaacagcctatggaggg

SEQ ID NO: 643 - DNA, 20 bp, Synthetic construct
  source 1..20: mol_type = other DNA
agtttccttttaccaagctg

SEQ ID NO: 644 - DNA, 20 bp, Synthetic construct
  source 1..20: mol_type = other DNA
cggatacgccaaatcccctc

SEQ ID NO: 645 - DNA, 20 bp, Synthetic construct
  source 1..20: mol_type = other DNA
caggtccaccaccacgaggc

SEQ ID NO: 646 - DNA, 20 bp, Synthetic construct
  source 1..20: mol_type = other DNA
cccccaccatcatctcccct

SEQ ID NO: 647 - DNA, 20 bp, Synthetic construct
  source 1..20: mol_type = other DNA
ggcattcgagccagggagag

SEQ ID NO: 648 - DNA, 20 bp, Synthetic construct
  source 1..20: mol_type = other DNA
gttgatcgagccgcagccgc

SEQ ID NO: 649 - DNA, 20 bp, Synthetic construct
  source 1..20: mol_type = other DNA
caggttggtttcatcctgga

SEQ ID NO: 650 - DNA, 20 bp, Synthetic construct
  source 1..20: mol_type = other DNA
actcaatcttcctctccaga

SEQ ID NO: 651 - DNA, 20 bp, Synthetic construct
  source 1..20: mol_type = other DNA
cctggagttcccgaacctcc

SEQ ID NO: 652 - DNA, 20 bp, Synthetic construct
  source 1..20: mol_type = other DNA
cgcagagactccaggtcgca

SEQ ID NO: 653 - DNA, 20 bp, Synthetic construct
  source 1..20: mol_type = other DNA
gtcctggtactcctgcaagt

SEQ ID NO: 654 - DNA, 20 bp, Synthetic construct
  source 1..20: mol_type = other DNA
acgatgttcctcttgaggtg

SEQ ID NO: 655 - DNA, 20 bp, Synthetic construct
  source 1..20: mol_type = other DNA
tggactccttaatgacctct

SEQ ID NO: 656 - DNA, 20 bp, Synthetic construct
  source 1..20: mol_type = other DNA
gcagaggccaccaggtgggt

SEQ ID NO: 657 - DNA, 20 bp, Synthetic construct
  source 1..20: mol_type = other DNA
ggtgagtttcttgttagttg

SEQ ID NO: 658 - DNA, 20 bp, Synthetic construct
  source 1..20: mol_type = other DNA
ccttcctcctcattctaacg

SEQ ID NO: 659 - DNA, 20 bp, Synthetic construct
  source 1..20: mol_type = other DNA
aacagtttccataacaacag

SEQ ID NO: 660 - DNA, 20 bp, Synthetic construct
  source 1..20: mol_type = other DNA
caaaggcacagttcccagat

SEQ ID NO: 661 - DNA, 20 bp, Synthetic construct
  source 1..20: mol_type = other DNA
ggccttccctttcctgtctg

SEQ ID NO: 662 - DNA, 20 bp, Synthetic construct
  source 1..20: mol_type = other DNA
tagactgatcagggtcagtc

SEQ ID NO: 663 - DNA, 20 bp, Synthetic construct
  source 1..20: mol_type = other DNA
cgtgcccacagatggcatcc

SEQ ID NO: 664 - DNA, 20 bp, Synthetic construct
  source 1..20: mol_type = other DNA
ccagcacctcatccctctcc

SEQ ID NO: 665 - DNA, 20 bp, Synthetic construct
  source 1..20: mol_type = other DNA
ccaggcagcccccctctatc

SEQ ID NO: 666 - DNA, 20 bp, Synthetic construct
  source 1..20: mol_type = other DNA
ccatcccaattgcctcctcc

SEQ ID NO: 667 - DNA, 20 bp, Synthetic construct
  source 1..20: mol_type = other DNA
acttccttaattcccacaat

SEQ ID NO: 668 - DNA, 20 bp, Synthetic construct
  source 1..20: mol_type = other DNA
atggatacatcccctttctc

SEQ ID NO: 669 - DNA, 20 bp, Synthetic construct
  source 1..20: mol_type = other DNA
tgcctcagttttacaattgt

SEQ ID NO: 670 - DNA, 20 bp, Synthetic construct
  source 1..20: mol_type = other DNA
gtctgctcaccagtctgctc

SEQ ID NO: 671 - DNA, 20 bp, Synthetic construct
  source 1..20: mol_type = other DNA
ggccctcccagtcccatctc

SEQ ID NO: 672 - DNA, 20 bp, Synthetic construct
  source 1..20: mol_type = other DNA
aaaggacaccaagtcttggg

SEQ ID NO: 673 - DNA, 20 bp, Synthetic construct
  source 1..20: mol_type = other DNA
ttgtctttatttttcctcag

SEQ ID NO: 674 - DNA, 20 bp, Synthetic construct
  source 1..20: mol_type = other DNA
ttggtgcttttgccccctcg

SEQ ID NO: 675 - DNA, 20 bp, Synthetic construct
  source 1..20: mol_type = other DNA
aggcagctaaccgcgagccg

SEQ ID NO: 676 - DNA, 20 bp, Synthetic construct
  source 1..20: mol_type = other DNA
ccacctttaccactaacaag

SEQ ID NO: 677 - DNA, 20 bp, Synthetic construct
  source 1..20: mol_type = other DNA
tcagaggccccagagcagct

SEQ ID NO: 678 - DNA, 20 bp, Synthetic construct
  source 1..20: mol_type = other DNA
aatatttaacattaagagca

SEQ ID NO: 679 - DNA, 20 bp, Synthetic construct
  source 1..20: mol_type = other DNA
ctccagtgcccttcccacga

SEQ ID NO: 680 - DNA, 20 bp, Synthetic construct
  source 1..20: mol_type = other DNA
gatccctttgccctgatcct

SEQ ID NO: 681 - DNA, 20 bp, Synthetic construct
  source 1..20: mol_type = other DNA
gcaagccccacctagaagta

SEQ ID NO: 682 - DNA, 20 bp, Synthetic construct
  source 1..20: mol_type = other DNA
acagaaaacactcagaaggg

SEQ ID NO: 683 - DNA, 20 bp, Synthetic construct
  source 1..20: mol_type = other DNA
aggccccccttccccatccc

SEQ ID NO: 684 - DNA, 20 bp, Synthetic construct
  source 1..20: mol_type = other DNA
ggccctgggcctgtttctgg

SEQ ID NO: 685 - DNA, 20 bp, Synthetic construct
  source 1..20: mol_type = other DNA
gagctcgctgcccacagtca

SEQ ID NO: 686 - DNA, 20 bp, Synthetic construct
  source 1..20: mol_type = other DNA
tggacatcaaccttctccgc

SEQ ID NO: 687 - DNA, 20 bp, Synthetic construct
  source 1..20: mol_type = other DNA
ccctcactttcttcacccca

SEQ ID NO: 688 - DNA, 20 bp, Synthetic construct
  source 1..20: mol_type = other DNA
ccaggtaaccaccttttgaa

SEQ ID NO: 689 - DNA, 20 bp, Synthetic construct
  source 1..20: mol_type = other DNA
gtgccttatcagggttggtg

SEQ ID NO: 690 - DNA, 20 bp, Synthetic construct
  source 1..20: mol_type = other DNA
tgggcttttgccttaactca

SEQ ID NO: 691 - DNA, 20 bp, Synthetic construct
  source 1..20: mol_type = other DNA
cctcagtctcccttgaggca

SEQ ID NO: 692 - DNA, 20 bp, Synthetic construct
  source 1..20: mol_type = other DNA
ccctcccctccacctccctg

SEQ ID NO: 693 - DNA, 20 bp, Synthetic construct
  source 1..20: mol_type = other DNA
ctcagccttgccttacccct

SEQ ID NO: 694 - DNA, 20 bp, Synthetic construct
  source 1..20: mol_type = other DNA
tctccctctctcagttgcaa

SEQ ID NO: 695 - DNA, 20 bp, Synthetic construct
  source 1..20: mol_type = other DNA
tgtctctttccgtctccctt

SEQ ID NO: 696 - DNA, 20 bp, Synthetic construct
  source 1..20: mol_type = other DNA
caggctggcccacaggcagg

SEQ ID NO: 697 - DNA, 20 bp, Synthetic construct
  source 1..20: mol_type = other DNA
gaggatattctcccagcttc

SEQ ID NO: 698 - DNA, 20 bp, Synthetic construct
  source 1..20: mol_type = other DNA
cacctacttcatagtaaggt

SEQ ID NO: 699 - DNA, 20 bp, Synthetic construct
  source 1..20: mol_type = other DNA
gttggaaatccaactctacc

SEQ ID NO: 700 - DNA, 20 bp, Synthetic construct
  source 1..20: mol_type = other DNA
aggctcagtaacccaaaaca

SEQ ID NO: 701 - DNA, 20 bp, Synthetic construct
  source 1..20: mol_type = other DNA
cagtgtctttcctggctccc

SEQ ID NO: 702 - DNA, 20 bp, Synthetic construct
  source 1..20: mol_type = other DNA
ggccctcccttcttctcttc

SEQ ID NO: 703 - DNA, 20 bp, Synthetic construct
  source 1..20: mol_type = other DNA
caccctgctcagacaccagt

SEQ ID NO: 704 - DNA, 20 bp, Synthetic construct
  source 1..20: mol_type = other DNA
ctcgcctggcctcaccctgg

SEQ ID NO: 705 - DNA, 20 bp, Synthetic construct
  source 1..20: mol_type = other DNA
gcgggctgccagacctcagc

SEQ ID NO: 706 - DNA, 20 bp, Synthetic construct
  source 1..20: mol_type = other DNA
cccgtcctgccctggccgcg

SEQ ID NO: 707 - DNA, 20 bp, Synthetic construct
  source 1..20: mol_type = other DNA
aaaaagactcagtccctgaa

SEQ ID NO: 708 - DNA, 20 bp, Synthetic construct
  source 1..20: mol_type = other DNA
ttggttgaatccatccatcc

SEQ ID NO: 709 - DNA, 20 bp, Synthetic construct
  source 1..20: mol_type = other DNA
cctagctttttccccagcag

SEQ ID NO: 710 - DNA, 20 bp, Synthetic construct
  source 1..20: mol_type = other DNA
actaatatttaacattaaga

SEQ ID NO: 711 - DNA, 20 bp, Synthetic construct
  source 1..20: mol_type = other DNA
tctagtggtcctaaatattc

SEQ ID NO: 712 - DNA, 20 bp, Synthetic construct
  source 1..20: mol_type = other DNA
ttcctacttctctctgccat

SEQ ID NO: 713 - DNA, 20 bp, Synthetic construct
  source 1..20: mol_type = other DNA
gctcaatacacataggtccc

SEQ ID NO: 714 - DNA, 20 bp, Synthetic construct
  source 1..20: mol_type = other DNA
cccaacttagccaccaacca

SEQ ID NO: 715 - DNA, 20 bp, Synthetic construct
  source 1..20: mol_type = other DNA
ctggctttctgaaaacccag

SEQ ID NO: 716 - DNA, 20 bp, Synthetic construct
  source 1..20: mol_type = other DNA
agcccccaaatcccaatagt

SEQ ID NO: 717 - DNA, 20 bp, Synthetic construct
  source 1..20: mol_type = other DNA
ccatcgcacccccctcccca

SEQ ID NO: 718 - DNA, 20 bp, Synthetic construct
  source 1..20: mol_type = other DNA
tccctccttacctctccatc

SEQ ID NO: 719 - DNA, 20 bp, Synthetic construct
  source 1..20: mol_type = other DNA
cccaggctttcctccatggc

SEQ ID NO: 720 - DNA, 20 bp, Synthetic construct
  source 1..20: mol_type = other DNA
cttagaacagcctatggagg

SEQ ID NO: 721 - DNA, 20 bp, Synthetic construct
  source 1..20: mol_type = other DNA
tagtttccttttaccaagct

SEQ ID NO: 722 - DNA, 20 bp, Synthetic construct
  source 1..20: mol_type = other DNA
gcggatacgccaaatcccct

SEQ ID NO: 723 - DNA, 20 bp, Synthetic construct
  source 1..20: mol_type = other DNA
cccaggtccaccaccacgag

SEQ ID NO: 724 - DNA, 20 bp, Synthetic construct
  source 1..20: mol_type = other DNA
gccccccaccatcatctccc

SEQ ID NO: 725 - DNA, 20 bp, Synthetic construct
  source 1..20: mol_type = other DNA
ccagggagaaatccacccgg

SEQ ID NO: 726 - DNA, 20 bp, Synthetic construct
  source 1..20: mol_type = other DNA
ggtgagttgatcgagccgca

SEQ ID NO: 727 - DNA, 20 bp, Synthetic construct
  source 1..20: mol_type = other DNA
ttccagcctcaggttggttt

SEQ ID NO: 728 - DNA, 20 bp, Synthetic construct
  source 1..20: mol_type = other DNA
ccagcgactcaatcttcctc

SEQ ID NO: 729 - DNA, 20 bp, Synthetic construct
  source 1..20: mol_type = other DNA
tgctgtcgggccagctgctc

SEQ ID NO: 730 - DNA, 20 bp, Synthetic construct
  source 1..20: mol_type = other DNA
cctcctgctcgcgcatctgc

SEQ ID NO: 731 - DNA, 20 bp, Synthetic construct
  source 1..20: mol_type = other DNA
ggtcctggtactcctgcaag

SEQ ID NO: 732 - DNA, 20 bp, Synthetic construct
  source 1..20: mol_type = other DNA
cacgatgttcctcttgaggt

SEQ ID NO: 733 - DNA, 20 bp, Synthetic construct
  source 1..20: mol_type = other DNA
ttggactccttaatgacctc

SEQ ID NO: 734 - DNA, 20 bp, Synthetic construct
  source 1..20: mol_type = other DNA
tcgggcccctcatgagacgg

SEQ ID NO: 735 - DNA, 20 bp, Synthetic construct
  source 1..20: mol_type = other DNA
atgcccctccagactgcccc

SEQ ID NO: 736 - DNA, 20 bp, Synthetic construct
  source 1..20: mol_type = other DNA
ctccttcctcctcattctaa

SEQ ID NO: 737 - DNA, 20 bp, Synthetic construct
  source 1..20: mol_type = other DNA
caacagtttccataacaaca

SEQ ID NO: 738 - DNA, 20 bp, Synthetic construct
  source 1..20: mol_type = other DNA
gaggaaactcaaaggcacag

SEQ ID NO: 739 - DNA, 20 bp, Synthetic construct
  source 1..20: mol_type = other DNA
gggccttccctttcctgtct

SEQ ID NO: 740 - DNA, 20 bp, Synthetic construct
  source 1..20: mol_type = other DNA
tcttagactgatcagggtca

SEQ ID NO: 741 - DNA, 20 bp, Synthetic construct
  source 1..20: mol_type = other DNA
gctcccacctgcccacagcg

SEQ ID NO: 742 - DNA, 20 bp, Synthetic construct
  source 1..20: mol_type = other DNA
tcccagcacctcatccctct

SEQ ID NO: 743 - DNA, 20 bp, Synthetic construct
  source 1..20: mol_type = other DNA
gccaggcagcccccctctat

SEQ ID NO: 744 - DNA, 20 bp, Synthetic construct
  source 1..20: mol_type = other DNA
caacccctacttgtatgcct

SEQ ID NO: 745 - DNA, 20 bp, Synthetic construct
  source 1..20: mol_type = other DNA
agaggatgagtcacttcctt

SEQ ID NO: 746 - DNA, 20 bp, Synthetic construct
  source 1..20: mol_type = other DNA
catggatacatcccctttct

SEQ ID NO: 747 - DNA, 20 bp, Synthetic construct
  source 1..20: mol_type = other DNA
cagtgtcttcactttgctcg

SEQ ID NO: 748 - DNA, 20 bp, Synthetic construct
  source 1..20: mol_type = other DNA
agtctgctcaccagtctgct

SEQ ID NO: 749 - DNA, 20 bp, Synthetic construct
  source 1..20: mol_type = other DNA
gggccctcccagtcccatct

SEQ ID NO: 750 - DNA, 20 bp, Synthetic construct
  source 1..20: mol_type = other DNA
gaaaggacaccaagtcttgg

SEQ ID NO: 751 - DNA, 20 bp, Synthetic construct
  source 1..20: mol_type = other DNA
tttgtctttatttttcctca

SEQ ID NO: 752 - DNA, 20 bp, Synthetic construct
  source 1..20: mol_type = other DNA
gattttccccgtctttggtg

SEQ ID NO: 753 - DNA, 20 bp, Synthetic construct
  source 1..20: mol_type = other DNA
gtgaggctcactccctgtca

SEQ ID NO: 754 - DNA, 20 bp, Synthetic construct
  source 1..20: mol_type = other DNA
accacctttaccactaacaa

SEQ ID NO: 755 - DNA, 20 bp, Synthetic construct
  source 1..20: mol_type = other DNA
gcttgctcagaggccccaga

SEQ ID NO: 756 - DNA, 20 bp, Synthetic construct
  source 1..20: mol_type = other DNA
taatatttaacattaagagc

SEQ ID NO: 757 - DNA, 20 bp, Synthetic construct
  source 1..20: mol_type = other DNA
gactccagtgcccttcccac

SEQ ID NO: 758 - DNA, 20 bp, Synthetic construct
  source 1..20: mol_type = other DNA
tggatccctttgccctgatc

SEQ ID NO: 759 - DNA, 20 bp, Synthetic construct
  source 1..20: mol_type = other DNA
gctgcaagccccacctagaa

SEQ ID NO: 760 - DNA, 20 bp, Synthetic construct
  source 1..20: mol_type = other DNA
aacagaaaacactcagaagg

SEQ ID NO: 761 - DNA, 20 bp, Synthetic construct
  source 1..20: mol_type = other DNA
aaggccccccttccccatcc

SEQ ID NO: 762 - DNA, 20 bp, Synthetic construct
  source 1..20: mol_type = other DNA
tgcgggcatcagatccccgg

SEQ ID NO: 763 - DNA, 20 bp, Synthetic construct
  source 1..20: mol_type = other DNA
tcctcctttatatggacaca

SEQ ID NO: 764 - DNA, 20 bp, Synthetic construct
  source 1..20: mol_type = other DNA
atggacatcaaccttctccg

SEQ ID NO: 765 - DNA, 20 bp, Synthetic construct
  source 1..20: mol_type = other DNA
tccctcactttcttcacccc

SEQ ID NO: 766 - DNA, 20 bp, Synthetic construct
  source 1..20: mol_type = other DNA
cccaggtaaccaccttttga

SEQ ID NO: 767 - DNA, 20 bp, Synthetic construct
  source 1..20: mol_type = other DNA
aaggtgccttatcagggttg

SEQ ID NO: 768 - DNA, 20 bp, Synthetic construct
  source 1..20: mol_type = other DNA
tgtgggcttttgccttaact

SEQ ID NO: 769 - DNA, 20 bp, Synthetic construct
  source 1..20: mol_type = other DNA
tacctgcctcagtctccctt

SEQ ID NO: 770 - DNA, 20 bp, Synthetic construct
  source 1..20: mol_type = other DNA
aatcctttcctccctcccct

SEQ ID NO: 771 - DNA, 20 bp, Synthetic construct
  source 1..20: mol_type = other DNA
tccccattcctcagccttgc

SEQ ID NO: 772 - DNA, 20 bp, Synthetic construct
  source 1..20: mol_type = other DNA
tgtctctccctctctcagtt

SEQ ID NO: 773 - DNA, 20 bp, Synthetic construct
  source 1..20: mol_type = other DNA
cttgtctctttccgtctccc

SEQ ID NO: 774 - DNA, 20 bp, Synthetic construct
  source 1..20: mol_type = other DNA
gcaggctggcccacaggcag

SEQ ID NO: 775 - DNA, 20 bp, Synthetic construct
  source 1..20: mol_type = other DNA
agaggatattctcccagctt

SEQ ID NO: 776 - DNA, 20 bp, Synthetic construct
  source 1..20: mol_type = other DNA
gcacctacttcatagtaagg

SEQ ID NO: 777 - DNA, 20 bp, Synthetic construct
  source 1..20: mol_type = other DNA
agttggaaatccaactctac

SEQ ID NO: 778 - DNA, 20 bp, Synthetic construct
  source 1..20: mol_type = other DNA
agaggctcagtaacccaaaa

SEQ ID NO: 779 - DNA, 20 bp, Synthetic construct
  source 1..20: mol_type = other DNA
cccctctacagtgtctttcc

SEQ ID NO: 780 - DNA, 20 bp, Synthetic construct
  source 1..20: mol_type = other DNA
tggccctcccttcttctctt

SEQ ID NO: 781 - DNA, 20 bp, Synthetic construct
  source 1..20: mol_type = other DNA
ggccctcaccctgctcagac

SEQ ID NO: 782 - DNA, 20 bp, Synthetic construct
  source 1..20: mol_type = other DNA
cctcgcctggcctcaccctg

SEQ ID NO: 783 - DNA, 20 bp, Synthetic construct
  source 1..20: mol_type = other DNA
actgtgacccatggatgcgg

SEQ ID NO: 784 - DNA, 20 bp, Synthetic construct
  source 1..20: mol_type = other DNA
cgcccgtccccgtcctgccc

SEQ ID NO: 785 - DNA, 20 bp, Synthetic construct
  source 1..20: mol_type = other DNA
tgaaaaagactcagtccctg

SEQ ID NO: 786 - DNA, 20 bp, Synthetic construct
  source 1..20: mol_type = other DNA
attggttgaatccatccatc

SEQ ID NO: 787 - DNA, 20 bp, Synthetic construct
  source 1..20: mol_type = other DNA
tcctagctttttccccagca

SEQ ID NO: 788 - DNA, 20 bp, Synthetic construct
  source 1..20: mol_type = other DNA
cactaatatttaacattaag

SEQ ID NO: 789 - DNA, 20 bp, Synthetic construct
  source 1..20: mol_type = other DNA
gacatgcatatctagtggtc

SEQ ID NO: 790 - DNA, 20 bp, Synthetic construct
  source 1..20: mol_type = other DNA
ctttcctacttctctctgcc

SEQ ID NO: 791 - DNA, 20 bp, Synthetic construct
  source 1..20: mol_type = other DNA
tgctcaatacacataggtcc

SEQ ID NO: 792 - DNA, 20 bp, Synthetic construct
  source 1..20: mol_type = other DNA
gaagtcccaacttagccacc

SEQ ID NO: 793 - DNA, 20 bp, Synthetic construct
  source 1..20: mol_type = other DNA
cctggctttctgaaaaccca

SEQ ID NO: 794 - DNA, 20 bp, Synthetic construct
  source 1..20: mol_type = other DNA
ggctggagagcccccaaatc

SEQ ID NO: 795 - DNA, 20 bp, Synthetic construct
  source 1..20: mol_type = other DNA
ggcttccccatcgcaccccc

SEQ ID NO: 796 - DNA, 20 bp, Synthetic construct
  source 1..20: mol_type = other DNA
atccctccttacctctccat

SEQ ID NO: 797 - DNA, 20 bp, Synthetic construct
  source 1..20: mol_type = other DNA
ccccaggctttcctccatgg

SEQ ID NO: 798 - DNA, 20 bp, Synthetic construct
  source 1..20: mol_type = other DNA
ccttagaacagcctatggag

SEQ ID NO: 799 - DNA, 20 bp, Synthetic construct
  source 1..20: mol_type = other DNA
tggtagtttccttttaccaa

SEQ ID NO: 800 - DNA, 20 bp, Synthetic construct
  source 1..20: mol_type = other DNA
ggcggatacgccaaatcccc

SEQ ID NO: 801 - DNA, 20 bp, Synthetic construct
  source 1..20: mol_type = other DNA
acagaccccaggtccaccac

SEQ ID NO: 802 - DNA, 20 bp, Synthetic construct
  source 1..20: mol_type = other DNA
ggccccccaccatcatctcc

SEQ ID NO: 803 - DNA, 20 bp, Synthetic construct
  source 1..20: mol_type = other DNA
gcattgagtgccccagccag

SEQ ID NO: 804 - DNA, 20 bp, Synthetic construct
  source 1..20: mol_type = other DNA
ccctctcaacctccagccgg

SEQ ID NO: 805 - DNA, 20 bp, Synthetic construct
  source 1..20: mol_type = other DNA
gcttccagcctcaggttggt

SEQ ID NO: 806 - DNA, 20 bp, Synthetic construct
  source 1..20: mol_type = other DNA
tccagcgactcaatcttcct

SEQ ID NO: 807 - DNA, 20 bp, Synthetic construct
  source 1..20: mol_type = other DNA
cgtcaagctccacatggacc

SEQ ID NO: 808 - DNA, 20 bp, Synthetic construct
  source 1..20: mol_type = other DNA
aactggccgcctcccgcacg

SEQ ID NO: 809 - DNA, 20 bp, Synthetic construct
  source 1..20: mol_type = other DNA
ggttggagaaggtctgcacg

SEQ ID NO: 810 - DNA, 20 bp, Synthetic construct
  source 1..20: mol_type = other DNA
ccacgatgttcctcttgagg

SEQ ID NO: 811 - DNA, 20 bp, Synthetic construct
  source 1..20: mol_type = other DNA
cttggactccttaatgacct

SEQ ID NO: 812 - DNA, 20 bp, Synthetic construct
  source 1..20: mol_type = other DNA
gctcgggcccctcatgagac

SEQ ID NO: 813 - DNA, 20 bp, Synthetic construct
  source 1..20: mol_type = other DNA
catgcccctccagactgccc

SEQ ID NO: 814 - DNA, 20 bp, Synthetic construct
  source 1..20: mol_type = other DNA
cgccctcctccccttctctc

SEQ ID NO: 815 - DNA, 20 bp, Synthetic construct
  source 1..20: mol_type = other DNA
ggcaacagtttccataacaa

SEQ ID NO: 816 - DNA, 20 bp, Synthetic construct
  source 1..20: mol_type = other DNA
tgaggaaactcaaaggcaca

SEQ ID NO: 817 - DNA, 20 bp, Synthetic construct
  source 1..20: mol_type = other DNA
cagggctaccttgtctgtgg

SEQ ID NO: 818 - DNA, 20 bp, Synthetic construct
  source 1..20: mol_type = other DNA
atcttagactgatcagggtc

SEQ ID NO: 819 - DNA, 20 bp, Synthetic construct
  source 1..20: mol_type = other DNA
agctcccacctgcccacagc

SEQ ID NO: 820 - DNA, 20 bp, Synthetic construct
  source 1..20: mol_type = other DNA
cctcccagcacctcatccct

SEQ ID NO: 821 - DNA, 20 bp, Synthetic construct
  source 1..20: mol_type = other DNA
tctctgtacccacagctggg

SEQ ID NO: 822 - DNA, 20 bp, Synthetic construct
  source 1..20: mol_type = other DNA
cacaacccctacttgtatgc

SEQ ID NO: 823 - DNA, 20 bp, Synthetic construct
  source 1..20: mol_type = other DNA
ttcagcatcttcaagaggat

SEQ ID NO: 824 - DNA, 20 bp, Synthetic construct
  source 1..20: mol_type = other DNA
ccatggatacatcccctttc

SEQ ID NO: 825 - DNA, 20 bp, Synthetic construct
  source 1..20: mol_type = other DNA
ccagtgtcttcactttgctc

SEQ ID NO: 826 - DNA, 20 bp, Synthetic construct
  source 1..20: mol_type = other DNA
cagtctgctcaccagtctgc

SEQ ID NO: 827 - DNA, 20 bp, Synthetic construct
  source 1..20: mol_type = other DNA
tgggccctcccagtcccatc

SEQ ID NO: 828 - DNA, 20 bp, Synthetic construct
  source 1..20: mol_type = other DNA
ggaaaggacaccaagtcttg

SEQ ID NO: 829 - DNA, 20 bp, Synthetic construct
  source 1..20: mol_type = other DNA
atttgtctttatttttcctc

SEQ ID NO: 830 - DNA, 20 bp, Synthetic construct
  source 1..20: mol_type = other DNA
tgtgattttccccgtctttg

SEQ ID NO: 831 - DNA, 20 bp, Synthetic construct
  source 1..20: mol_type = other DNA
ggtgaggctcactccctgtc

SEQ ID NO: 832 - DNA, 20 bp, Synthetic construct
  source 1..20: mol_type = other DNA
caccacctttaccactaaca

SEQ ID NO: 833 - DNA, 20 bp, Synthetic construct
  source 1..20: mol_type = other DNA
ctgcttgctcagaggcccca

SEQ ID NO: 834 - DNA, 20 bp, Synthetic construct
  source 1..20: mol_type = other DNA
ctgacctcgaatctgcaggt

SEQ ID NO: 835 - DNA, 20 bp, Synthetic construct
  source 1..20: mol_type = other DNA
gggcaggactccagtgccct

SEQ ID NO: 836 - DNA, 20 bp, Synthetic construct
  source 1..20: mol_type = other DNA
ctggatccctttgccctgat

SEQ ID NO: 837 - DNA, 20 bp, Synthetic construct
  source 1..20: mol_type = other DNA
cacccagttctgctgtcgaa

SEQ ID NO: 838 - DNA, 20 bp, Synthetic construct
  source 1..20: mol_type = other DNA
caaaaacagaaaacactcag

SEQ ID NO: 839 - DNA, 20 bp, Synthetic construct
  source 1..20: mol_type = other DNA
acaaggccccccttccccat

SEQ ID NO: 840 - DNA, 20 bp, Synthetic construct
  source 1..20: mol_type = other DNA
cactgctttccccagtaggg

SEQ ID NO: 841 - DNA, 20 bp, Synthetic construct
  source 1..20: mol_type = other DNA
ctcctcctttatatggacac

SEQ ID NO: 842 - DNA, 20 bp, Synthetic construct
  source 1..20: mol_type = other DNA
cctcatggacatcaaccttc

SEQ ID NO: 843 - DNA, 20 bp, Synthetic construct
  source 1..20: mol_type = other DNA
ttccctcactttcttcaccc

SEQ ID NO: 844 - DNA, 20 bp, Synthetic construct
  source 1..20: mol_type = other DNA
tcccaggtaaccaccttttg

SEQ ID NO: 845 - DNA, 20 bp, Synthetic construct
  source 1..20: mol_type = other DNA
ctaaggtgccttatcagggt

SEQ ID NO: 846 - DNA, 20 bp, Synthetic construct
  source 1..20: mol_type = other DNA
acccaggaccagtagagcag

SEQ ID NO: 847 - DNA, 20 bp, Synthetic construct
  source 1..20: mol_type = other DNA
aatacctgcctcagtctccc

SEQ ID NO: 848 - DNA, 20 bp, Synthetic construct
  source 1..20: mol_type = other DNA
caatcctttcctccctcccc

SEQ ID NO: 849 - DNA, 20 bp, Synthetic construct
  source 1..20: mol_type = other DNA
ctccccattcctcagccttg

SEQ ID NO: 850 - DNA, 20 bp, Synthetic construct
  source 1..20: mol_type = other DNA
ctcagcttctctgtctctgt

SEQ ID NO: 851 - DNA, 20 bp, Synthetic construct
  source 1..20: mol_type = other DNA
cccctcggccaggagttcga

SEQ ID NO: 852 - DNA, 20 bp, Synthetic construct
  source 1..20: mol_type = other DNA
ccccattctcttgtacagag

SEQ ID NO: 853 - DNA, 20 bp, Synthetic construct
  source 1..20: mol_type = other DNA
gagaggatattctcccagct

SEQ ID NO: 854 - DNA, 20 bp, Synthetic construct
  source 1..20: mol_type = other DNA
aagaacagcacctacttcat

SEQ ID NO: 855 - DNA, 20 bp, Synthetic construct
  source 1..20: mol_type = other DNA
gagttggaaatccaactcta

SEQ ID NO: 856 - DNA, 20 bp, Synthetic construct
  source 1..20: mol_type = other DNA
gtagaggctcagtaacccaa

SEQ ID NO: 857 - DNA, 20 bp, Synthetic construct
  source 1..20: mol_type = other DNA
atgccccctctacagtgtct

SEQ ID NO: 858 - DNA, 20 bp, Synthetic construct
  source 1..20: mol_type = other DNA
aatggccctcccttcttctc

SEQ ID NO: 859 - DNA, 20 bp, Synthetic construct
  source 1..20: mol_type = other DNA
ccatcgggccctcaccctgc

SEQ ID NO: 860 - DNA, 20 bp, Synthetic construct
  source 1..20: mol_type = other DNA
accttccacactgacagctg

SEQ ID NO: 861 - DNA, 20 bp, Synthetic construct
  source 1..20: mol_type = other DNA
caactgtgacccatggatgc

SEQ ID NO: 862 - DNA, 20 bp, Synthetic construct
  source 1..20: mol_type = other DNA
ctgctccgcccgtccccgtc

SEQ ID NO: 863 - DNA, 20 bp, Synthetic construct
  source 1..20: mol_type = other DNA
ctgaaaaagactcagtccct

SEQ ID NO: 864 - DNA, 20 bp, Synthetic construct
  source 1..20: mol_type = other DNA
atattggttgaatccatcca

SEQ ID NO: 865 - DNA, 20 bp, Synthetic construct
  source 1..20: mol_type = other DNA
tctaactccatctcctagct

SEQ ID NO: 866 - DNA, 20 bp, Synthetic construct
  source 1..20: mol_type = other DNA
tcactaatatttaacattaa

SEQ ID NO: 867 - DNA, 20 bp, Synthetic construct
  source 1..20: mol_type = other DNA
gctgaattaagtcctgagac

SEQ ID NO: 868 - DNA, 20 bp, Synthetic construct
  source 1..20: mol_type = other DNA
tctttcctacttctctctgc

SEQ ID NO: 869 - DNA, 20 bp, Synthetic construct
  source 1..20: mol_type = other DNA
aggctgttaaacatgtggca

SEQ ID NO: 870 - DNA, 20 bp, Synthetic construct
  source 1..20: mol_type = other DNA
agaagtcccaacttagccac

SEQ ID NO: 871 - DNA, 20 bp, Synthetic construct
  source 1..20: mol_type = other DNA
acctggctttctgaaaaccc

SEQ ID NO: 872 - DNA, 20 bp, Synthetic construct
  source 1..20: mol_type = other DNA
aggctcttccaaacgggctg

SEQ ID NO: 873 - DNA, 20 bp, Synthetic construct
  source 1..20: mol_type = other DNA
ccggcttccccatcgcaccc

SEQ ID NO: 874 - DNA, 20 bp, Synthetic construct
  source 1..20: mol_type = other DNA
aatccctccttacctctcca

SEQ ID NO: 875 - DNA, 20 bp, Synthetic construct
  source 1..20: mol_type = other DNA
tgccagccccaggctttcct

SEQ ID NO: 876 - DNA, 20 bp, Synthetic construct
  source 1..20: mol_type = other DNA
ctccccttagaacagcctat

SEQ ID NO: 877 - DNA, 20 bp, Synthetic construct
  source 1..20: mol_type = other DNA
ctggtagtttccttttacca

SEQ ID NO: 878 - DNA, 20 bp, Synthetic construct
  source 1..20: mol_type = other DNA
tggcggatacgccaaatccc

SEQ ID NO: 879 - DNA, 20 bp, Synthetic construct
  source 1..20: mol_type = other DNA
gagttcacacagaccccagg

SEQ ID NO: 880 - DNA, 20 bp, Synthetic construct
  source 1..20: mol_type = other DNA
aggccccccaccatcatctc

SEQ ID NO: 881 - DNA, 20 bp, Synthetic construct
  source 1..20: mol_type = other DNA
cagcattgagtgccccagcc

SEQ ID NO: 882 - DNA, 20 bp, Synthetic construct
  source 1..20: mol_type = other DNA
tccctctcaacctccagccg

SEQ ID NO: 883 - DNA, 20 bp, Synthetic construct
  source 1..20: mol_type = other DNA
ggcttccagcctcaggttgg

SEQ ID NO: 884 - DNA, 20 bp, Synthetic construct
  source 1..20: mol_type = other DNA
ctccagcgactcaatcttcc

SEQ ID NO: 885 - DNA, 20 bp, Synthetic construct
  source 1..20: mol_type = other DNA
gatctctttcagggctgcgg

SEQ ID NO: 886 - DNA, 20 bp, Synthetic construct
  source 1..20: mol_type = other DNA
ataactggccgcctcccgca

SEQ ID NO: 887 - DNA, 20 bp, Synthetic construct
  source 1..20: mol_type = other DNA
ggtttctcgaatctgcaggt

SEQ ID NO: 888 - DNA, 20 bp, Synthetic construct
  source 1..20: mol_type = other DNA
cttcaccacgatgttcctct

SEQ ID NO: 889 - DNA, 20 bp, Synthetic construct
  source 1..20: mol_type = other DNA
gcttggactccttaatgacc

SEQ ID NO: 890 - DNA, 20 bp, Synthetic construct
  source 1..20: mol_type = other DNA
tgctcgggcccctcatgaga

SEQ ID NO: 891 - DNA, 20 bp, Synthetic construct
  source 1..20: mol_type = other DNA
ccatgcccctccagactgcc

SEQ ID NO: 892 - DNA, 20 bp, Synthetic construct
  source 1..20: mol_type = other DNA
ccgccctcctccccttctct

SEQ ID NO: 893 - DNA, 20 bp, Synthetic construct
  source 1..20: mol_type = other DNA
tctggcaacagtttccataa

SEQ ID NO: 894 - DNA, 20 bp, Synthetic construct
  source 1..20: mol_type = other DNA
ctgaggaaactcaaaggcac

SEQ ID NO: 895 - DNA, 20 bp, Synthetic construct
  source 1..20: mol_type = other DNA
gccagggctaccttgtctgt

SEQ ID NO: 896 - DNA, 20 bp, Synthetic construct
  source 1..20: mol_type = other DNA
catcttagactgatcagggt

SEQ ID NO: 897 - DNA, 20 bp, Synthetic construct
  source 1..20: mol_type = other DNA
caagctcccacctgcccaca

SEQ ID NO: 898 - DNA, 20 bp, Synthetic construct
  source 1..20: mol_type = other DNA
tctatccctcccagcacctc

SEQ ID NO: 899 - DNA, 20 bp, Synthetic construct
  source 1..20: mol_type = other DNA
ctctctgtacccacagctgg

SEQ ID NO: 900 - DNA, 20 bp, Synthetic construct
  source 1..20: mol_type = other DNA
ccacaacccctacttgtatg

SEQ ID NO: 901 - DNA, 20 bp, Synthetic construct
  source 1..20: mol_type = other DNA
tttcagcatcttcaagagga

SEQ ID NO: 902 - DNA, 20 bp, Synthetic construct
  source 1..20: mol_type = other DNA
cccatggatacatccccttt

SEQ ID NO: 903 - DNA, 20 bp, Synthetic construct
  source 1..20: mol_type = other DNA
agccagtgtcttcactttgc

SEQ ID NO: 904 - DNA, 20 bp, Synthetic construct
  source 1..20: mol_type = other DNA
gatcccaccagtctgctcac

SEQ ID NO: 905 - DNA, 20 bp, Synthetic construct
  source 1..20: mol_type = other DNA
gtgggccctcccagtcccat

SEQ ID NO: 906 - DNA, 20 bp, Synthetic construct
  source 1..20: mol_type = other DNA
tgccctgaagattagcagca

SEQ ID NO: 907 - DNA, 20 bp, Synthetic construct
  source 1..20: mol_type = other DNA
catttgtctttatttttcct

SEQ ID NO: 908 - DNA, 20 bp, Synthetic construct
  source 1..20: mol_type = other DNA
ttgtgattttccccgtcttt

SEQ ID NO: 909 - DNA, 20 bp, Synthetic construct
  source 1..20: mol_type = other DNA
acgcagtccaggccctttag

SEQ ID NO: 910 - DNA, 20 bp, Synthetic construct
  source 1..20: mol_type = other DNA
ctcaccacctttaccactaa

SEQ ID NO: 911 - DNA, 20 bp, Synthetic construct
  source 1..20: mol_type = other DNA
agaggtgagacagaggctgc

SEQ ID NO: 912 - DNA, 20 bp, Synthetic construct
  source 1..20: mol_type = other DNA
tactgacctcgaatctgcag

SEQ ID NO: 913 - DNA, 20 bp, Synthetic construct
  source 1..20: mol_type = other DNA
cctacaggccctggaggagg

SEQ ID NO: 914 - DNA, 20 bp, Synthetic construct
  source 1..20: mol_type = other DNA
agctggatccctttgccctg

SEQ ID NO: 915 - DNA, 20 bp, Synthetic construct
  source 1..20: mol_type = other DNA
ctctcacccagttctgctgt

SEQ ID NO: 916 - DNA, 20 bp, Synthetic construct
  source 1..20: mol_type = other DNA
ccctgtagtgacaagcagtt

SEQ ID NO: 917 - DNA, 20 bp, Synthetic construct
  source 1..20: mol_type = other DNA
ccttctgctcacaaggcccc

SEQ ID NO: 918 - DNA, 20 bp, Synthetic construct
  source 1..20: mol_type = other DNA
aagcccagccatgaatgaaa

SEQ ID NO: 919 - DNA, 20 bp, Synthetic construct
  source 1..20: mol_type = other DNA
aactcctcctttatatggac

SEQ ID NO: 920 - DNA, 20 bp, Synthetic construct
  source 1..20: mol_type = other DNA
ccaatctccctcatggacat

SEQ ID NO: 921 - DNA, 20 bp, Synthetic construct
  source 1..20: mol_type = other DNA
ctgctctttccctcactttc

SEQ ID NO: 922 - DNA, 20 bp, Synthetic construct
  source 1..20: mol_type = other DNA
atcccaggtaaccacctttt

SEQ ID NO: 923 - DNA, 20 bp, Synthetic construct
  source 1..20: mol_type = other DNA
actaaggtgccttatcaggg

SEQ ID NO: 924 - DNA, 20 bp, Synthetic construct
  source 1..20: mol_type = other DNA
cacccaggaccagtagagca

SEQ ID NO: 925 - DNA, 20 bp, Synthetic construct
  source 1..20: mol_type = other DNA
acttgaatacctgcctcagt

SEQ ID NO: 926 - DNA, 20 bp, Synthetic construct
  source 1..20: mol_type = other DNA
atcaatcctttcctccctcc

SEQ ID NO: 927 - DNA, 20 bp, Synthetic construct
  source 1..20: mol_type = other DNA
cttctccccattcctcagcc

SEQ ID NO: 928 - DNA, 20 bp, Synthetic construct
  source 1..20: mol_type = other DNA
agtgtctctctcagtctcag

SEQ ID NO: 929 - DNA, 20 bp, Synthetic construct
  source 1..20: mol_type = other DNA
ctcttctgcctgcccctcgg

SEQ ID NO: 930 - DNA, 20 bp, Synthetic construct
  source 1..20: mol_type = other DNA
tcccccattctcttgtacag

SEQ ID NO: 931 - DNA, 20 bp, Synthetic construct
  source 1..20: mol_type = other DNA
ggagaggatattctcccagc

SEQ ID NO: 932 - DNA, 20 bp, Synthetic construct
  source 1..20: mol_type = other DNA
ctgtcaaagaacagcaccta

SEQ ID NO: 933 - DNA, 20 bp, Synthetic construct
  source 1..20: mol_type = other DNA
agagttggaaatccaactct

SEQ ID NO: 934 - DNA, 20 bp, Synthetic construct
  source 1..20: mol_type = other DNA
ggtcagacacctctctgtgt

SEQ ID NO: 935 - DNA, 20 bp, Synthetic construct
  source 1..20: mol_type = other DNA
gcctagcccaaatgccccct

SEQ ID NO: 936 - DNA, 20 bp, Synthetic construct
  source 1..20: mol_type = other DNA
gctctgtcctccactaggaa

SEQ ID NO: 937 - DNA, 20 bp, Synthetic construct
  source 1..20: mol_type = other DNA
cccatcgggccctcaccctg

SEQ ID NO: 938 - DNA, 20 bp, Synthetic construct
  source 1..20: mol_type = other DNA
agaaccttccacactgacag

SEQ ID NO: 939 - DNA, 20 bp, Synthetic construct
  source 1..20: mol_type = other DNA
aacaactgtgacccatggat

SEQ ID NO: 940 - DNA, 20 bp, Synthetic construct
  source 1..20: mol_type = other DNA
ccctgctccgcccgtccccg

SEQ ID NO: 941 - DNA, 20 bp, Synthetic construct
  source 1..20: mol_type = other DNA
gctgaaaaagactcagtccc

SEQ ID NO: 942 - DNA, 20 bp, Synthetic construct
  source 1..20: mol_type = other DNA
gtccttggccttgaggccta

SEQ ID NO: 943 - DNA, 20 bp, Synthetic construct
  source 1..20: mol_type = other DNA
agtctaactccatctcctag

SEQ ID NO: 944 - DNA, 20 bp, Synthetic construct
  source 1..20: mol_type = other DNA
cattcactaatatttaacat

SEQ ID NO: 945 - DNA, 20 bp, Synthetic construct
  source 1..20: mol_type = other DNA
gttagcctttctgatgctga

SEQ ID NO: 946 - DNA, 20 bp, Synthetic construct
  source 1..20: mol_type = other DNA
ctctttcctacttctctctg

SEQ ID NO: 947 - DNA, 20 bp, Synthetic construct
  source 1..20: mol_type = other DNA
ggcctacttctctaggtggg

SEQ ID NO: 948 - DNA, 20 bp, Synthetic construct
  source 1..20: mol_type = other DNA
aagaagtcccaacttagcca

SEQ ID NO: 949 - DNA, 20 bp, Synthetic construct
  source 1..20: mol_type = other DNA
cctctgcaagccctggcctg

SEQ ID NO: 950 - DNA, 20 bp, Synthetic construct
  source 1..20: mol_type = other DNA
taggctcttccaaacgggct

SEQ ID NO: 951 - DNA, 20 bp, Synthetic construct
  source 1..20: mol_type = other DNA
cccggcttccccatcgcacc

SEQ ID NO: 952 - DNA, 20 bp, Synthetic construct
  source 1..20: mol_type = other DNA
ccaaatccctccttacctct

SEQ ID NO: 953 - DNA, 20 bp, Synthetic construct
  source 1..20: mol_type = other DNA
ggaaccttctatgtgccagc

SEQ ID NO: 954 - DNA, 20 bp, Synthetic construct
  source 1..20: mol_type = other DNA
gctttggtaccaaggctccc

SEQ ID NO: 955 - DNA, 20 bp, Synthetic construct
  source 1..20: mol_type = other DNA
cctggtagtttccttttacc

SEQ ID NO: 956 - DNA, 20 bp, Synthetic construct
  source 1..20: mol_type = other DNA
gctggagtaagatgagctcc

SEQ ID NO: 957 - DNA, 20 bp, Synthetic construct
  source 1..20: mol_type = other DNA
cagtgcaacagttaggagtt

SEQ ID NO: 958 - DNA, 20 bp, Synthetic construct
  source 1..20: mol_type = other DNA
caggccccccaccatcatct

SEQ ID NO: 959 - DNA, 20 bp, Synthetic construct
  source 1..20: mol_type = other DNA
ccttgaagccagcattgagt

SEQ ID NO: 960 - DNA, 20 bp, Synthetic construct
  source 1..20: mol_type = other DNA
gtccctctcaacctccagcc

SEQ ID NO: 961 - DNA, 20 bp, Synthetic construct
  source 1..20: mol_type = other DNA
ctcggcttccagcctcaggt

SEQ ID NO: 962 - DNA, 20 bp, Synthetic construct
  source 1..20: mol_type = other DNA
tcctcctccagcgactcaat

SEQ ID NO: 963 - DNA, 20 bp, Synthetic construct
  source 1..20: mol_type = other DNA
gtgcggatctctttcagggc

SEQ ID NO: 964 - DNA, 20 bp, Synthetic construct
  source 1..20: mol_type = other DNA
gataactggccgcctcccgc

SEQ ID NO: 965 - DNA, 20 bp, Synthetic construct
  source 1..20: mol_type = other DNA
ctggtttctcgaatctgcag

SEQ ID NO: 966 - DNA, 20 bp, Synthetic construct
  source 1..20: mol_type = other DNA
ggtcttcaccacgatgttcc

SEQ ID NO: 967 - DNA, 20 bp, Synthetic construct
  source 1..20: mol_type = other DNA
cacatcacatccttgtgctc

SEQ ID NO: 968 - DNA, 20 bp, Synthetic construct
  source 1..20: mol_type = other DNA
tctgctcgggcccctcatga

SEQ ID NO: 969 - DNA, 20 bp, Synthetic construct
  source 1..20: mol_type = other DNA
gccatgcccctccagactgc

SEQ ID NO: 970 - DNA, 20 bp, Synthetic construct
  source 1..20: mol_type = other DNA
cccgccctcctccccttctc

SEQ ID NO: 971 - DNA, 20 bp, Synthetic construct
  source 1..20: mol_type = other DNA
tctctggcaacagtttccat

SEQ ID NO: 972 - DNA, 20 bp, Synthetic construct
  source 1..20: mol_type = other DNA
cctgaggaaactcaaaggca

SEQ ID NO: 973 - DNA, 20 bp, Synthetic construct
  source 1..20: mol_type = other DNA
ggccagggctaccttgtctg

SEQ ID NO: 974 - DNA, 20 bp, Synthetic construct
  source 1..20: mol_type = other DNA
ccatcttagactgatcaggg

SEQ ID NO: 975 - DNA, 20 bp, Synthetic construct
  source 1..20: mol_type = other DNA
tcaagctcccacctgcccac

SEQ ID NO: 976 - DNA, 20 bp, Synthetic construct
  source 1..20: mol_type = other DNA
ctctatccctcccagcacct

SEQ ID NO: 977 - DNA, 20 bp, Synthetic construct
  source 1..20: mol_type = other DNA
cctctctgtacccacagctg

SEQ ID NO: 978 - DNA, 20 bp, Synthetic construct
  source 1..20: mol_type = other DNA
cccacaacccctacttgtat

SEQ ID NO: 979 - DNA, 20 bp, Synthetic construct
  source 1..20: mol_type = other DNA
ctcctgtttcagcatcttca

SEQ ID NO: 980 - DNA, 20 bp, Synthetic construct
  source 1..20: mol_type = other DNA
ccccatggatacatcccctt

SEQ ID NO: 981 - DNA, 20 bp, Synthetic construct
  source 1..20: mol_type = other DNA
ggaatatgagccagtgtctt

SEQ ID NO: 982 - DNA, 20 bp, Synthetic construct
  source 1..20: mol_type = other DNA
cagatcccaccagtctgctc

SEQ ID NO: 983 - DNA, 20 bp, Synthetic construct
  source 1..20: mol_type = other DNA
gaagtgggccctcccagtcc

SEQ ID NO: 984 - DNA, 20 bp, Synthetic construct
  source 1..20: mol_type = other DNA
gtgccctgaagattagcagc

SEQ ID NO: 985 - DNA, 20 bp, Synthetic construct
  source 1..20: mol_type = other DNA
gcatttgtctttatttttcc

SEQ ID NO: 986 - DNA, 20 bp, Synthetic construct
  source 1..20: mol_type = other DNA
cttgtgattttccccgtctt

SEQ ID NO: 987 - DNA, 20 bp, Synthetic construct
  source 1..20: mol_type = other DNA
atgacgcagtccaggccctt

SEQ ID NO: 988 - DNA, 20 bp, Synthetic construct
  source 1..20: mol_type = other DNA
actcaccacctttaccacta

SEQ ID NO: 989 - DNA, 20 bp, Synthetic construct
  source 1..20: mol_type = other DNA
aagaggtgagacagaggctg

SEQ ID NO: 990 - DNA, 20 bp, Synthetic construct
  source 1..20: mol_type = other DNA
gtactgacctcgaatctgca

SEQ ID NO: 991 - DNA, 20 bp, Synthetic construct
  source 1..20: mol_type = other DNA
agcaacctacaggccctgga

SEQ ID NO: 992 - DNA, 20 bp, Synthetic construct
  source 1..20: mol_type = other DNA
gagctggatccctttgccct

SEQ ID NO: 993 - DNA, 20 bp, Synthetic construct
  source 1..20: mol_type = other DNA
gctctcacccagttctgctg

SEQ ID NO: 994 - DNA, 20 bp, Synthetic construct
  source 1..20: mol_type = other DNA
ccccctgtagtgacaagcag

SEQ ID NO: 995 - DNA, 20 bp, Synthetic construct
  source 1..20: mol_type = other DNA
gaggttcggcccctccctga

SEQ ID NO: 996 - DNA, 20 bp, Synthetic construct
  source 1..20: mol_type = other DNA
aaagcccagccatgaatgaa

SEQ ID NO: 997 - DNA, 20 bp, Synthetic construct
  source 1..20: mol_type = other DNA
caactcctcctttatatgga

SEQ ID NO: 998 - DNA, 20 bp, Synthetic construct
  source 1..20: mol_type = other DNA
atccaatctccctcatggac

SEQ ID NO: 999 - DNA, 20 bp, Synthetic construct
  source 1..20: mol_type = other DNA
gcctgctctttccctcactt

SEQ ID NO: 1000 - DNA, 20 bp, Synthetic construct
  source 1..20: mol_type = other DNA
tctgatcccaggtaaccacc

SEQ ID NO: 1001 - DNA, 20 bp, Synthetic construct
  source 1..20: mol_type = other DNA
tactaaggtgccttatcagg

SEQ ID NO: 1002 - DNA, 20 bp, Synthetic construct
  source 1..20: mol_type = other DNA
acccccacccaggaccagta

SEQ ID NO: 1003 - DNA, 20 bp, Synthetic construct
  source 1..20: mol_type = other DNA
gacacttgaatacctgcctc

SEQ ID NO: 1004 - DNA, 20 bp, Synthetic construct
  source 1..20: mol_type = other DNA
catcaatcctttcctccctc

SEQ ID NO: 1005 - DNA, 20 bp, Synthetic construct
  source 1..20: mol_type = other DNA
tccttctccccattcctcag

SEQ ID NO: 1006 - DNA, 20 bp, Synthetic construct
  source 1..20: mol_type = other DNA
tctctgagtgtctctctcag

SEQ ID NO: 1007 - DNA, 20 bp, Synthetic construct
  source 1..20: mol_type = other DNA
cctcttctgcctgcccctcg

SEQ ID NO: 1008 - DNA, 20 bp, Synthetic construct
  source 1..20: mol_type = other DNA
ttcccccattctcttgtaca

SEQ ID NO: 1009 - DNA, 20 bp, Synthetic construct
  source 1..20: mol_type = other DNA
ggtgaaagtcagtcacctgg

SEQ ID NO: 1010 - DNA, 20 bp, Synthetic construct
  source 1..20: mol_type = other DNA
atctgtcaaagaacagcacc

SEQ ID NO: 1011 - DNA, 20 bp, Synthetic construct
  source 1..20: mol_type = other DNA
tagagttggaaatccaactc

SEQ ID NO: 1012 - DNA, 20 bp, Synthetic construct
  source 1..20: mol_type = other DNA
acaccttccaggtcagacac

SEQ ID NO: 1013 - DNA, 20 bp, Synthetic construct
  source 1..20: mol_type = other DNA
tgcctagcccaaatgccccc

SEQ ID NO: 1014 - DNA, 20 bp, Synthetic construct
  source 1..20: mol_type = other DNA
aggctctgtcctccactagg

SEQ ID NO: 1015 - DNA, 20 bp, Synthetic construct
  source 1..20: mol_type = other DNA
cctcccagccccatcgggcc

SEQ ID NO: 1016 - DNA, 20 bp, Synthetic construct
  source 1..20: mol_type = other DNA
cagaaccttccacactgaca

SEQ ID NO: 1017 - DNA, 20 bp, Synthetic construct
  source 1..20: mol_type = other DNA
ttcccaacaactgtgaccca

SEQ ID NO: 1018 - DNA, 20 bp, Synthetic construct
  source 1..20: mol_type = other DNA
tggcccttctcccctggcat

SEQ ID NO: 1019 - DNA, 20 bp, Synthetic construct
  source 1..20: mol_type = other DNA
aaggctgaaaaagactcagt

SEQ ID NO: 1020 - DNA, 20 bp, Synthetic construct
  source 1..20: mol_type = other DNA
gtgacccaagtccttggcct

SEQ ID NO: 1021 - DNA, 20 bp, Synthetic construct
  source 1..20: mol_type = other DNA
ggaaagtctaactccatctc

SEQ ID NO: 1022 - DNA, 20 bp, Synthetic construct
  source 1..20: mol_type = other DNA
acattcactaatatttaaca

SEQ ID NO: 1023 - DNA, 20 bp, Synthetic construct
  source 1..20: mol_type = other DNA
ctggttagcctttctgatgc

SEQ ID NO: 1024 - DNA, 20 bp, Synthetic construct
  source 1..20: mol_type = other DNA
tcctctttcctacttctctc

SEQ ID NO: 1025 - DNA, 20 bp, Synthetic construct
  source 1..20: mol_type = other DNA
gggcctacttctctaggtgg

SEQ ID NO: 1026 - DNA, 20 bp, Synthetic construct
  source 1..20: mol_type = other DNA
agctcaagaagtcccaactt

SEQ ID NO: 1027 - DNA, 20 bp, Synthetic construct
  source 1..20: mol_type = other DNA
gcttcatttcagcccctctg

SEQ ID NO: 1028 - DNA, 20 bp, Synthetic construct
  source 1..20: mol_type = other DNA
ctaggctcttccaaacgggc

SEQ ID NO: 1029 - DNA, 20 bp, Synthetic construct
  source 1..20: mol_type = other DNA
tgcccggcttccccatcgca

SEQ ID NO: 1030 - DNA, 20 bp, Synthetic construct
  source 1..20: mol_type = other DNA
gcccaaatccctccttacct

SEQ ID NO: 1031 - DNA, 20 bp, Synthetic construct
  source 1..20: mol_type = other DNA
gctgggaaccttctatgtgc

SEQ ID NO: 1032 - DNA, 20 bp, Synthetic construct
  source 1..20: mol_type = other DNA
ggctttggtaccaaggctcc

SEQ ID NO: 1033 - DNA, 20 bp, Synthetic construct
  source 1..20: mol_type = other DNA
cccctggtagtttcctttta

SEQ ID NO: 1034 - DNA, 20 bp, Synthetic construct
  source 1..20: mol_type = other DNA
tggtgagataacactgggaa

SEQ ID NO: 1035 - DNA, 20 bp, Synthetic construct
  source 1..20: mol_type = other DNA
acagtgcaacagttaggagt

SEQ ID NO: 1036 - DNA, 20 bp, Synthetic construct
  source 1..20: mol_type = other DNA
ccaggccccccaccatcatc

SEQ ID NO: 1037 - DNA, 20 bp, Synthetic construct
  source 1..20: mol_type = other DNA
ctccttgaagccagcattga

SEQ ID NO: 1038 - DNA, 20 bp, Synthetic construct
  source 1..20: mol_type = other DNA
tgtccctctcaacctccagc

SEQ ID NO: 1039 - DNA, 20 bp, Synthetic construct
  source 1..20: mol_type = other DNA
ttctcggcttccagcctcag

SEQ ID NO: 1040 - DNA, 20 bp, Synthetic construct
  source 1..20: mol_type = other DNA
atctcctcctccagcgactc

SEQ ID NO: 1041 - DNA, 20 bp, Synthetic construct
  source 1..20: mol_type = other DNA
acgccattgcctcatactgc

SEQ ID NO: 1042 - DNA, 20 bp, Synthetic construct
  source 1..20: mol_type = other DNA
tgataactggccgcctcccg

SEQ ID NO: 1043 - DNA, 20 bp, Synthetic construct
  source 1..20: mol_type = other DNA
ggctggtttctcgaatctgc

SEQ ID NO: 1044 - DNA, 20 bp, Synthetic construct
  source 1..20: mol_type = other DNA
acggtcttcaccacgatgtt

SEQ ID NO: 1045 - DNA, 20 bp, Synthetic construct
  source 1..20: mol_type = other DNA
tcacatcacatccttgtgct

SEQ ID NO: 1046 - DNA, 20 bp, Synthetic construct
  source 1..20: mol_type = other DNA
atcctgcttctgctcgggcc

SEQ ID NO: 1047 - DNA, 20 bp, Synthetic construct
  source 1..20: mol_type = other DNA
tggccatgcccctccagact

SEQ ID NO: 1048 - DNA, 20 bp, Synthetic construct
  source 1..20: mol_type = other DNA
ccccgccctcctccccttct

SEQ ID NO: 1049 - DNA, 20 bp, Synthetic construct
  source 1..20: mol_type = other DNA
atctctggcaacagtttcca

SEQ ID NO: 1050 - DNA, 20 bp, Synthetic construct
  source 1..20: mol_type = other DNA
gcctgaggaaactcaaaggc

SEQ ID NO: 1051 - DNA, 20 bp, Synthetic construct
  source 1..20: mol_type = other DNA
tggccagggctaccttgtct

SEQ ID NO: 1052 - DNA, 20 bp, Synthetic construct
  source 1..20: mol_type = other DNA
ccccacccatcttagactga

SEQ ID NO: 1053 - DNA, 20 bp, Synthetic construct
  source 1..20: mol_type = other DNA
aatcaagctcccacctgccc

SEQ ID NO: 1054 - DNA, 20 bp, Synthetic construct
  source 1..20: mol_type = other DNA
cctctatccctcccagcacc

SEQ ID NO: 1055 - DNA, 20 bp, Synthetic construct
  source 1..20: mol_type = other DNA
cttgacctctctgtacccac

SEQ ID NO: 1056 - DNA, 20 bp, Synthetic construct
  source 1..20: mol_type = other DNA
cacccacaacccctacttgt

SEQ ID NO: 1057 - DNA, 20 bp, Synthetic construct
  source 1..20: mol_type = other DNA
tctcctgtttcagcatcttc

SEQ ID NO: 1058 - DNA, 20 bp, Synthetic construct
  source 1..20: mol_type = other DNA
ccctgcccccatggatacat

SEQ ID NO: 1059 - DNA, 20 bp, Synthetic construct
  source 1..20: mol_type = other DNA
gctgcaggaatatgagccag

SEQ ID NO: 1060 - DNA, 20 bp, Synthetic construct
  source 1..20: mol_type = other DNA
acagatcccaccagtctgct

SEQ ID NO: 1061 - DNA, 20 bp, Synthetic construct
  source 1..20: mol_type = other DNA
tgaagtgggccctcccagtc

SEQ ID NO: 1062 - DNA, 20 bp, Synthetic construct
  source 1..20: mol_type = other DNA
cagcagtgccctgaagatta

SEQ ID NO: 1063 - DNA, 20 bp, Synthetic construct
  source 1..20: mol_type = other DNA
agcatttgtctttatttttc

SEQ ID NO: 1064 - DNA, 20 bp, Synthetic construct
  source 1..20: mol_type = other DNA
ccttgtgattttccccgtct

SEQ ID NO: 1065 - DNA, 20 bp, Synthetic construct
  source 1..20: mol_type = other DNA
tacagttactctgtaccacg

SEQ ID NO: 1066 - DNA, 20 bp, Synthetic construct
  source 1..20: mol_type = other DNA
gactcaccacctttaccact

SEQ ID NO: 1067 - DNA, 20 bp, Synthetic construct
  source 1..20: mol_type = other DNA
gatgaaagaataaagcagag

SEQ ID NO: 1068 - DNA, 20 bp, Synthetic construct
  source 1..20: mol_type = other DNA
tgtactgacctcgaatctgc

SEQ ID NO: 1069 - DNA, 20 bp, Synthetic construct
  source 1..20: mol_type = other DNA
ggagcaacctacaggccctg

SEQ ID NO: 1070 - DNA, 20 bp, Synthetic construct
  source 1..20: mol_type = other DNA
agagctggatccctttgccc

SEQ ID NO: 1071 - DNA, 20 bp, Synthetic construct
  source 1..20: mol_type = other DNA
agctctcacccagttctgct

SEQ ID NO: 1072 - DNA, 20 bp, Synthetic construct
  source 1..20: mol_type = other DNA
cttttgccccctgtagtgac

SEQ ID NO: 1073 - DNA, 20 bp, Synthetic construct
  source 1..20: mol_type = other DNA
gtgccccatcaagaggtagg

SEQ ID NO: 1074 - DNA, 20 bp, Synthetic construct
  source 1..20: mol_type = other DNA
acaaagcccagccatgaatg

SEQ ID NO: 1075 - DNA, 20 bp, Synthetic construct
  source 1..20: mol_type = other DNA
ccaactcctcctttatatgg

SEQ ID NO: 1076 - DNA, 20 bp, Synthetic construct
  source 1..20: mol_type = other DNA
aatccaatctccctcatgga

SEQ ID NO: 1077 - DNA, 20 bp, Synthetic construct
  source 1..20: mol_type = other DNA
ctgcctgctctttccctcac

SEQ ID NO: 1078 - DNA, 20 bp, Synthetic construct
  source 1..20: mol_type = other DNA
ctctgatcccaggtaaccac

SEQ ID NO: 1079 - DNA, 20 bp, Synthetic construct
  source 1..20: mol_type = other DNA
aactcattactaaggtgcct

SEQ ID NO: 1080 - DNA, 20 bp, Synthetic construct
  source 1..20: mol_type = other DNA
cacccccacccaggaccagt

SEQ ID NO: 1081 - DNA, 20 bp, Synthetic construct
  source 1..20: mol_type = other DNA
ggacacttgaatacctgcct

SEQ ID NO: 1082 - DNA, 20 bp, Synthetic construct
  source 1..20: mol_type = other DNA
ccatcaatcctttcctccct

SEQ ID NO: 1083 - DNA, 20 bp, Synthetic construct
  source 1..20: mol_type = other DNA
ggctccttctccccattcct

SEQ ID NO: 1084 - DNA, 20 bp, Synthetic construct
  source 1..20: mol_type = other DNA
tgtttctctcctctctctga

SEQ ID NO: 1085 - DNA, 20 bp, Synthetic construct
  source 1..20: mol_type = other DNA
ttgtgtcctcttctgcctgc

SEQ ID NO: 1086 - DNA, 20 bp, Synthetic construct
  source 1..20: mol_type = other DNA
ccttcccccattctcttgta

SEQ ID NO: 1087 - DNA, 20 bp, Synthetic construct
  source 1..20: mol_type = other DNA
ttctctggtgaaagtcagtc

SEQ ID NO: 1088 - DNA, 20 bp, Synthetic construct
  source 1..20: mol_type = other DNA
ctcatctgtcaaagaacagc

SEQ ID NO: 1089 - DNA, 20 bp, Synthetic construct
  source 1..20: mol_type = other DNA
ctcccaagtgagatgtgcta

SEQ ID NO: 1090 - DNA, 20 bp, Synthetic construct
  source 1..20: mol_type = other DNA
cacaccttccaggtcagaca

SEQ ID NO: 1091 - DNA, 20 bp, Synthetic construct
  source 1..20: mol_type = other DNA
ctgcctagcccaaatgcccc

SEQ ID NO: 1092 - DNA, 20 bp, Synthetic construct
  source 1..20: mol_type = other DNA
ttctgcctccaggctctgtc

SEQ ID NO: 1093 - DNA, 20 bp, Synthetic construct
  source 1..20: mol_type = other DNA
ggaggtcctcccagccccat

SEQ ID NO: 1094 - DNA, 20 bp, Synthetic construct
  source 1..20: mol_type = other DNA
ccagaaccttccacactgac

SEQ ID NO: 1095 - DNA, 20 bp, Synthetic construct
  source 1..20: mol_type = other DNA
acttttcccaacaactgtga

SEQ ID NO: 1096 - DNA, 20 bp, Synthetic construct
  source 1..20: mol_type = other DNA
ctggcccttctcccctggca

SEQ ID NO: 1097 - DNA, 20 bp, Synthetic construct
  source 1..20: mol_type = other DNA
caaggctgaaaaagactcag

SEQ ID NO: 1098 - DNA, 20 bp, Synthetic construct
  source 1..20: mol_type = other DNA
agggtgacccaagtccttgg

SEQ ID NO: 1099 - DNA, 20 bp, Synthetic construct
  source 1..20: mol_type = other DNA
caggaaagtctaactccatc

SEQ ID NO: 1100 - DNA, 20 bp, Synthetic construct
  source 1..20: mol_type = other DNA
gcctggttagcctttctgat

SEQ ID NO: 1101 - DNA, 20 bp, Synthetic construct
  source 1..20: mol_type = other DNA
ccctttcctctttcctactt

SEQ ID NO: 1102 - DNA, 20 bp, Synthetic construct
  source 1..20: mol_type = other DNA
tgtaaaataaggatgatggg

SEQ ID NO: 1103 - DNA, 20 bp, Synthetic construct
  source 1..20: mol_type = other DNA
cagagctcaagaagtcccaa

SEQ ID NO: 1104 - DNA, 20 bp, Synthetic construct
  source 1..20: mol_type = other DNA
ggcttcatttcagcccctct

SEQ ID NO: 1105 - DNA, 20 bp, Synthetic construct
  source 1..20: mol_type = other DNA
gcctaggctcttccaaacgg

SEQ ID NO: 1106 - DNA, 20 bp, Synthetic construct
  source 1..20: mol_type = other DNA
ccatcctctcccatgcccgg

SEQ ID NO: 1107 - DNA, 20 bp, Synthetic construct
  source 1..20: mol_type = other DNA
ggcccaaatccctccttacc

SEQ ID NO: 1108 - DNA, 20 bp, Synthetic construct
  source 1..20: mol_type = other DNA
ctctcctccagaattccctg

SEQ ID NO: 1109 - DNA, 20 bp, Synthetic construct
  source 1..20: mol_type = other DNA
taggatcccatctagtggct

SEQ ID NO: 1110 - DNA, 20 bp, Synthetic construct
  source 1..20: mol_type = other DNA
tcccattcccctggtagttt

SEQ ID NO: 1111 - DNA, 20 bp, Synthetic construct
  source 1..20: mol_type = other DNA
ggtggtgagataacactggg

SEQ ID NO: 1112 - DNA, 20 bp, Synthetic construct
  source 1..20: mol_type = other DNA
ggactccttaatgacctgca

SEQ ID NO: 1113 - DNA, 20 bp, Synthetic construct
  source 1..20: mol_type = other DNA
gccaggccccccaccatcat

SEQ ID NO: 1114 - DNA, 20 bp, Synthetic construct
  source 1..20: mol_type = other DNA
tctccttgaagccagcattg

SEQ ID NO: 1115 - DNA, 20 bp, Synthetic construct
  source 1..20: mol_type = other DNA
gattgtccctctcaacctcc

SEQ ID NO: 1116 - DNA, 20 bp, Synthetic construct
  source 1..20: mol_type = other DNA
ataggcagccaggttgttct

SEQ ID NO: 1117 - DNA, 20 bp, Synthetic construct
  source 1..20: mol_type = other DNA
gatctcctcctccagcgact

SEQ ID NO: 1118 - DNA, 20 bp, Synthetic construct
  source 1..20: mol_type = other DNA
ttcggcttcatgcatgttgc

SEQ ID NO: 1119 - DNA, 20 bp, Synthetic construct
  source 1..20: mol_type = other DNA
cctcctgataactggccgcc

SEQ ID NO: 1120 - DNA, 20 bp, Synthetic construct
  source 1..20: mol_type = other DNA
aggctggtttctcgaatctg

SEQ ID NO: 1121 - DNA, 20 bp, Synthetic construct
  source 1..20: mol_type = other DNA
cacggtcttcaccacgatgt

SEQ ID NO: 1122 - DNA, 20 bp, Synthetic construct
  source 1..20: mol_type = other DNA
cctcacatcacatccttgtg

SEQ ID NO: 1123 - DNA, 20 bp, Synthetic construct
  source 1..20: mol_type = other DNA
agcaactatcctgcttctgc

SEQ ID NO: 1124 - DNA, 20 bp, Synthetic construct
  source 1..20: mol_type = other DNA
gctggccatgcccctccaga

SEQ ID NO: 1125 - DNA, 20 bp, Synthetic construct
  source 1..20: mol_type = other DNA
cccccgccctcctccccttc

SEQ ID NO: 1126 - DNA, 20 bp, Synthetic construct
  source 1..20: mol_type = other DNA
aacctccatctctggcaaca

SEQ ID NO: 1127 - DNA, 20 bp, Synthetic construct
  source 1..20: mol_type = other DNA
ctccagcagcctgaggaaac

SEQ ID NO: 1128 - DNA, 20 bp, Synthetic construct
  source 1..20: mol_type = other DNA
gcctctggccagggctacct

SEQ ID NO: 1129 - DNA, 20 bp, Synthetic construct
  source 1..20: mol_type = other DNA
tccccacccatcttagactg

SEQ ID NO: 1130 - DNA, 20 bp, Synthetic construct
  source 1..20: mol_type = other DNA
gctgagaatcaagctcccac

SEQ ID NO: 1131 - DNA, 20 bp, Synthetic construct
  source 1..20: mol_type = other DNA
ccctctatccctcccagcac

SEQ ID NO: 1132 - DNA, 20 bp, Synthetic construct
  source 1..20: mol_type = other DNA
gggcttgacctctctgtacc

SEQ ID NO: 1133 - DNA, 20 bp, Synthetic construct
  source 1..20: mol_type = other DNA
tcacccacaacccctacttg

SEQ ID NO: 1134 - DNA, 20 bp, Synthetic construct
  source 1..20: mol_type = other DNA
ctctcctgtttcagcatctt

SEQ ID NO: 1135 - DNA, 20 bp, Synthetic construct
  source 1..20: mol_type = other DNA
atgccctgcccccatggata

SEQ ID NO: 1136 - DNA, 20 bp, Synthetic construct
  source 1..20: mol_type = other DNA
cccggcctccaggctgcagg

SEQ ID NO: 1137 - DNA, 20 bp, Synthetic construct
  source 1..20: mol_type = other DNA
cacagatcccaccagtctgc

SEQ ID NO: 1138 - DNA, 20 bp, Synthetic construct
  source 1..20: mol_type = other DNA
gaggagaaccctgaagtggg

SEQ ID NO: 1139 - DNA, 20 bp, Synthetic construct
  source 1..20: mol_type = other DNA
agcagcagtgccctgaagat

SEQ ID NO: 1140 - DNA, 20 bp, Synthetic construct
  source 1..20: mol_type = other DNA
cagcatttgtctttattttt

SEQ ID NO: 1141 - DNA, 20 bp, Synthetic construct
  source 1..20: mol_type = other DNA
accttgtgattttccccgtc

SEQ ID NO: 1142 - DNA, 20 bp, Synthetic construct
  source 1..20: mol_type = other DNA
gtacagttactctgtaccac

SEQ ID NO: 1143 - DNA, 20 bp, Synthetic construct
  source 1..20: mol_type = other DNA
ggactcaccacctttaccac

SEQ ID NO: 1144 - DNA, 20 bp, Synthetic construct
  source 1..20: mol_type = other DNA
ggatgaaagaataaagcaga

SEQ ID NO: 1145 - DNA, 20 bp, Synthetic construct
  source 1..20: mol_type = other DNA
ctgtactgacctcgaatctg

SEQ ID NO: 1146 - DNA, 20 bp, Synthetic construct
  source 1..20: mol_type = other DNA
gtctggagcaacctacaggc

SEQ ID NO: 1147 - DNA, 20 bp, Synthetic construct
  source 1..20: mol_type = other DNA
cacgaaggcccccagggaga

SEQ ID NO: 1148 - DNA, 20 bp, Synthetic construct
  source 1..20: mol_type = other DNA
aagctctcacccagttctgc

SEQ ID NO: 1149 - DNA, 20 bp, Synthetic construct
  source 1..20: mol_type = other DNA
tgcttttgccccctgtagtg

SEQ ID NO: 1150 - DNA, 20 bp, Synthetic construct
  source 1..20: mol_type = other DNA
tagtgccccatcaagaggta

SEQ ID NO: 1151 - DNA, 20 bp, Synthetic construct
  source 1..20: mol_type = other DNA
tcacaaagcccagccatgaa

SEQ ID NO: 1152 - DNA, 20 bp, Synthetic construct
  source 1..20: mol_type = other DNA
tccaactcctcctttatatg

SEQ ID NO: 1153 - DNA, 20 bp, Synthetic construct
  source 1..20: mol_type = other DNA
gaatccaatctccctcatgg

SEQ ID NO: 1154 - DNA, 20 bp, Synthetic construct
  source 1..20: mol_type = other DNA
ccagacctgcctgctctttc

SEQ ID NO: 1155 - DNA, 20 bp, Synthetic construct
  source 1..20: mol_type = other DNA
tcctctgatcccaggtaacc

SEQ ID NO: 1156 - DNA, 20 bp, Synthetic construct
  source 1..20: mol_type = other DNA
taactcattactaaggtgcc

SEQ ID NO: 1157 - DNA, 20 bp, Synthetic construct
  source 1..20: mol_type = other DNA
gaccacccccacccaggacc

SEQ ID NO: 1158 - DNA, 20 bp, Synthetic construct
  source 1..20: mol_type = other DNA
aggacacttgaatacctgcc

SEQ ID NO: 1159 - DNA, 20 bp, Synthetic construct
  source 1..20: mol_type = other DNA
gccatcaatcctttcctccc

SEQ ID NO: 1160 - DNA, 20 bp, Synthetic construct
  source 1..20: mol_type = other DNA
aggctccttctccccattcc

SEQ ID NO: 1161 - DNA, 20 bp, Synthetic construct
  source 1..20: mol_type = other DNA
ctgccaatctctgtttctct

SEQ ID NO: 1162 - DNA, 20 bp, Synthetic construct
  source 1..20: mol_type = other DNA
ttccccacgccattgtgtcc

SEQ ID NO: 1163 - DNA, 20 bp, Synthetic construct
  source 1..20: mol_type = other DNA
tccttcccccattctcttgt

SEQ ID NO: 1164 - DNA, 20 bp, Synthetic construct
  source 1..20: mol_type = other DNA
ccatctcacttctctggtga

SEQ ID NO: 1165 - DNA, 20 bp, Synthetic construct
  source 1..20: mol_type = other DNA
cggctctctcatctgtcaaa

SEQ ID NO: 1166 - DNA, 20 bp, Synthetic construct
  source 1..20: mol_type = other DNA
gcaggctcccaagtgagatg

SEQ ID NO: 1167 - DNA, 20 bp, Synthetic construct
  source 1..20: mol_type = other DNA
cgtcaatatcacaccttcca

SEQ ID NO: 1168 - DNA, 20 bp, Synthetic construct
  source 1..20: mol_type = other DNA
cctgcctagcccaaatgccc

SEQ ID NO: 1169 - DNA, 20 bp, Synthetic construct
  source 1..20: mol_type = other DNA
gcttttctgcctccaggctc

SEQ ID NO: 1170 - DNA, 20 bp, Synthetic construct
  source 1..20: mol_type = other DNA
cctttctcccctgcctgcag

SEQ ID NO: 1171 - DNA, 20 bp, Synthetic construct
  source 1..20: mol_type = other DNA
tccagaaccttccacactga

SEQ ID NO: 1172 - DNA, 20 bp, Synthetic construct
  source 1..20: mol_type = other DNA
gacttttcccaacaactgtg

SEQ ID NO: 1173 - DNA, 20 bp, Synthetic construct
  source 1..20: mol_type = other DNA
ccctggcccttctcccctgg

SEQ ID NO: 1174 - DNA, 20 bp, Synthetic construct
  source 1..20: mol_type = other DNA
acaaggctgaaaaagactca

SEQ ID NO: 1175 - DNA, 20 bp, Synthetic construct
  source 1..20: mol_type = other DNA
gagggtgacccaagtccttg

SEQ ID NO: 1176 - DNA, 20 bp, Synthetic construct
  source 1..20: mol_type = other DNA
gccaggaaagtctaactcca

SEQ ID NO: 1177 - DNA, 20 bp, Synthetic construct
  source 1..20: mol_type = other DNA
gtcacattcactaatattta

SEQ ID NO: 1178 - DNA, 20 bp, Synthetic construct
  source 1..20: mol_type = other DNA
cctctactagtcagcctggt

SEQ ID NO: 1179 - DNA, 20 bp, Synthetic construct
  source 1..20: mol_type = other DNA
tcccctttcctctttcctac

SEQ ID NO: 1180 - DNA, 20 bp, Synthetic construct
  source 1..20: mol_type = other DNA
ctctgggcaagttaattgac

SEQ ID NO: 1181 - DNA, 20 bp, Synthetic construct
  source 1..20: mol_type = other DNA
accagagctcaagaagtccc

SEQ ID NO: 1182 - DNA, 20 bp, Synthetic construct
  source 1..20: mol_type = other DNA
tggcttcatttcagcccctc

SEQ ID NO: 1183 - DNA, 20 bp, Synthetic construct
  source 1..20: mol_type = other DNA
cagagagagcctaggctctt

SEQ ID NO: 1184 - DNA, 20 bp, Synthetic construct
  source 1..20: mol_type = other DNA
tgagccatcctctcccatgc

SEQ ID NO: 1185 - DNA, 20 bp, Synthetic construct
  source 1..20: mol_type = other DNA
ctgggcccaaatccctcctt

SEQ ID NO: 1186 - DNA, 20 bp, Synthetic construct
  source 1..20: mol_type = other DNA
tgctctcctccagaattccc

SEQ ID NO: 1187 - DNA, 20 bp, Synthetic construct
  source 1..20: mol_type = other DNA
ctaactttaattctctttct

SEQ ID NO: 1188 - DNA, 20 bp, Synthetic construct
  source 1..20: mol_type = other DNA
ttcccattcccctggtagtt

SEQ ID NO: 1189 - DNA, 20 bp, Synthetic construct
  source 1..20: mol_type = other DNA
gggtggtgagataacactgg

SEQ ID NO: 1190 - DNA, 20 bp, Synthetic construct
  source 1..20: mol_type = other DNA
tggactccttaatgacctgc

SEQ ID NO: 1191 - DNA, 20 bp, Synthetic construct
  source 1..20: mol_type = other DNA
gagccaggccccccaccatc

SEQ ID NO: 1192 - DNA, 20 bp, Synthetic construct
  source 1..20: mol_type = other DNA
cgggtctccttgaagccagc

SEQ ID NO: 1193 - DNA, 20 bp, Synthetic construct
  source 1..20: mol_type = other DNA
ccagattgtccctctcaacc

SEQ ID NO: 1194 - DNA, 20 bp, Synthetic construct
  source 1..20: mol_type = other DNA
gcttcctgtctataggcagc

SEQ ID NO: 1195 - DNA, 20 bp, Synthetic construct
  source 1..20: mol_type = other DNA
ggatctcctcctccagcgac

SEQ ID NO: 1196 - DNA, 20 bp, Synthetic construct
  source 1..20: mol_type = other DNA
tcttcggcttcatgcatgtt

SEQ ID NO: 1197 - DNA, 20 bp, Synthetic construct
  source 1..20: mol_type = other DNA
cgcctcctgataactggccg

SEQ ID NO: 1198 - DNA, 20 bp, Synthetic construct
  source 1..20: mol_type = other DNA
agacttggtgtccaggctgg

SEQ ID NO: 1199 - DNA, 20 bp, Synthetic construct
  source 1..20: mol_type = other DNA
ctccacggtcttcaccacga

SEQ ID NO: 1200 - DNA, 20 bp, Synthetic construct
  source 1..20: mol_type = other DNA
gcctcacatcacatccttgt

SEQ ID NO: 1201 - DNA, 20 bp, Synthetic construct
  source 1..20: mol_type = other DNA
gagcaactatcctgcttctg

SEQ ID NO: 1202 - DNA, 20 bp, Synthetic construct
  source 1..20: mol_type = other DNA
gctgctggccatgcccctcc

SEQ ID NO: 1203 - DNA, 20 bp, Synthetic construct
  source 1..20: mol_type = other DNA
gccccccgccctcctcccct

SEQ ID NO: 1204 - DNA, 20 bp, Synthetic construct
  source 1..20: mol_type = other DNA
gagaacctccatctctggca

SEQ ID NO: 1205 - DNA, 20 bp, Synthetic construct
  source 1..20: mol_type = other DNA
cagttttcctccagcagcct

SEQ ID NO: 1206 - DNA, 20 bp, Synthetic construct
  source 1..20: mol_type = other DNA
acaaaacaagcctctggcca

SEQ ID NO: 1207 - DNA, 20 bp, Synthetic construct
  source 1..20: mol_type = other DNA
gtccccacccatcttagact

SEQ ID NO: 1208 - DNA, 20 bp, Synthetic construct
  source 1..20: mol_type = other DNA
tgctgagaatcaagctccca

SEQ ID NO: 1209 - DNA, 20 bp, Synthetic construct
  source 1..20: mol_type = other DNA
cccctctatccctcccagca

SEQ ID NO: 1210 - DNA, 20 bp, Synthetic construct
  source 1..20: mol_type = other DNA
tgggcttgacctctctgtac

SEQ ID NO: 1211 - DNA, 20 bp, Synthetic construct
  source 1..20: mol_type = other DNA
gtcacccacaacccctactt

SEQ ID NO: 1212 - DNA, 20 bp, Synthetic construct
  source 1..20: mol_type = other DNA
cctttctctcctgtttcagc

SEQ ID NO: 1213 - DNA, 20 bp, Synthetic construct
  source 1..20: mol_type = other DNA
catgccctgcccccatggat

SEQ ID NO: 1214 - DNA, 20 bp, Synthetic construct
  source 1..20: mol_type = other DNA
cacccggcctccaggctgca

SEQ ID NO: 1215 - DNA, 20 bp, Synthetic construct
  source 1..20: mol_type = other DNA
gcacagatcccaccagtctg

SEQ ID NO: 1216 - DNA, 20 bp, Synthetic construct
  source 1..20: mol_type = other DNA
agaggagaaccctgaagtgg

SEQ ID NO: 1217 - DNA, 20 bp, Synthetic construct
  source 1..20: mol_type = other DNA
ctcagcgactaaaggcagca

SEQ ID NO: 1218 - DNA, 20 bp, Synthetic construct
  source 1..20: mol_type = other DNA
gcagcatttgtctttatttt

SEQ ID NO: 1219 - DNA, 20 bp, Synthetic construct
  source 1..20: mol_type = other DNA
tgaccttgtgattttccccg

SEQ ID NO: 1220 - DNA, 20 bp, Synthetic construct
  source 1..20: mol_type = other DNA
tgtacagttactctgtacca

SEQ ID NO: 1221 - DNA, 20 bp, Synthetic construct
  source 1..20: mol_type = other DNA
aggactcaccacctttacca

SEQ ID NO: 1222 - DNA, 20 bp, Synthetic construct
  source 1..20: mol_type = other DNA
gggatgaaagaataaagcag

SEQ ID NO: 1223 - DNA, 20 bp, Synthetic construct
  source 1..20: mol_type = other DNA
gctgtactgacctcgaatct

SEQ ID NO: 1224 - DNA, 20 bp, Synthetic construct
  source 1..20: mol_type = other DNA
ctcagtcccagtctggagca

SEQ ID NO: 1225 - DNA, 20 bp, Synthetic construct
  source 1..20: mol_type = other DNA
gcagtgtcacgaaggccccc

SEQ ID NO: 1226 - DNA, 20 bp, Synthetic construct
  source 1..20: mol_type = other DNA
tcaagctctcacccagttct

SEQ ID NO: 1227 - DNA, 20 bp, Synthetic construct
  source 1..20: mol_type = other DNA
ggtgcttttgccccctgtag

SEQ ID NO: 1228 - DNA, 20 bp, Synthetic construct
  source 1..20: mol_type = other DNA
atagtgccccatcaagaggt

SEQ ID NO: 1229 - DNA, 20 bp, Synthetic construct
  source 1..20: mol_type = other DNA
gtcacaaagcccagccatga

SEQ ID NO: 1230 - DNA, 20 bp, Synthetic construct
  source 1..20: mol_type = other DNA
cttccaactcctcctttata

SEQ ID NO: 1231 - DNA, 20 bp, Synthetic construct
  source 1..20: mol_type = other DNA
agaatccaatctccctcatg

SEQ ID NO: 1232 - DNA, 20 bp, Synthetic construct
  source 1..20: mol_type = other DNA
cgcccagacctgcctgctct

SEQ ID NO: 1233 - DNA, 20 bp, Synthetic construct
  source 1..20: mol_type = other DNA
ttcctctgatcccaggtaac

SEQ ID NO: 1234 - DNA, 20 bp, Synthetic construct
  source 1..20: mol_type = other DNA
ttaactcattactaaggtgc

SEQ ID NO: 1235 - DNA, 20 bp, Synthetic construct
  source 1..20: mol_type = other DNA
agaccacccccacccaggac

SEQ ID NO: 1236 - DNA, 20 bp, Synthetic construct
  source 1..20: mol_type = other DNA
ccaggctcttctgaggacac

SEQ ID NO: 1237 - DNA, 20 bp, Synthetic construct
  source 1..20: mol_type = other DNA
ggccatcaatcctttcctcc

SEQ ID NO: 1238 - DNA, 20 bp, Synthetic construct
  source 1..20: mol_type = other DNA
ccaggctccttctccccatt

SEQ ID NO: 1239 - DNA, 20 bp, Synthetic construct
  source 1..20: mol_type = other DNA
ctctacctgccaatctctgt

SEQ ID NO: 1240 - DNA, 20 bp, Synthetic construct
  source 1..20: mol_type = other DNA
gttccccacgccattgtgtc

SEQ ID NO: 1241 - DNA, 20 bp, Synthetic construct
  source 1..20: mol_type = other DNA
ctccttcccccattctcttg

SEQ ID NO: 1242 - DNA, 20 bp, Synthetic construct
  source 1..20: mol_type = other DNA
gctactactaataatagcaa

SEQ ID NO: 1243 - DNA, 20 bp, Synthetic construct
  source 1..20: mol_type = other DNA
ttcggctctctcatctgtca

SEQ ID NO: 1244 - DNA, 20 bp, Synthetic construct
  source 1..20: mol_type = other DNA
atgcaggctcccaagtgaga

SEQ ID NO: 1245 - DNA, 20 bp, Synthetic construct
  source 1..20: mol_type = other DNA
ccacactacatataagctct

SEQ ID NO: 1246 - DNA, 20 bp, Synthetic construct
  source 1..20: mol_type = other DNA
tcctgcctagcccaaatgcc

SEQ ID NO: 1247 - DNA, 20 bp, Synthetic construct
  source 1..20: mol_type = other DNA
tgtgcttttctgcctccagg

SEQ ID NO: 1248 - DNA, 20 bp, Synthetic construct
  source 1..20: mol_type = other DNA
tagccctttctcccctgcct

SEQ ID NO: 1249 - DNA, 20 bp, Synthetic construct
  source 1..20: mol_type = other DNA
atccagaaccttccacactg

SEQ ID NO: 1250 - DNA, 20 bp, Synthetic construct
  source 1..20: mol_type = other DNA
gggacttttcccaacaactg

SEQ ID NO: 1251 - DNA, 20 bp, Synthetic construct
  source 1..20: mol_type = other DNA
cgtccctggcccttctcccc

SEQ ID NO: 1252 - DNA, 20 bp, Synthetic construct
  source 1..20: mol_type = other DNA
cacaaggctgaaaaagactc

SEQ ID NO: 1253 - DNA, 20 bp, Synthetic construct
  source 1..20: mol_type = other DNA
ggagggtgacccaagtcctt

SEQ ID NO: 1254 - DNA, 20 bp, Synthetic construct
  source 1..20: mol_type = other DNA
tgccaggaaagtctaactcc

SEQ ID NO: 1255 - DNA, 20 bp, Synthetic construct
  source 1..20: mol_type = other DNA
tccccccgccccgcccgaga

SEQ ID NO: 1256 - DNA, 20 bp, Synthetic construct
  source 1..20: mol_type = other DNA
ctgtcccctttcctctttcc

SEQ ID NO: 1257 - DNA, 20 bp, Synthetic construct
  source 1..20: mol_type = other DNA
ccaaccagccacatgactct

SEQ ID NO: 1258 - DNA, 20 bp, Synthetic construct
  source 1..20: mol_type = other DNA
tcaggagaccagagctcaag

SEQ ID NO: 1259 - DNA, 20 bp, Synthetic construct
  source 1..20: mol_type = other DNA
cctggcttcatttcagcccc

SEQ ID NO: 1260 - DNA, 20 bp, Synthetic construct
  source 1..20: mol_type = other DNA
gcagagagagcctaggctct

SEQ ID NO: 1261 - DNA, 20 bp, Synthetic construct
  source 1..20: mol_type = other DNA
ggcatgagccatcctctccc

SEQ ID NO: 1262 - DNA, 20 bp, Synthetic construct
  source 1..20: mol_type = other DNA
actgggcccaaatccctcct

SEQ ID NO: 1263 - DNA, 20 bp, Synthetic construct
  source 1..20: mol_type = other DNA
ttgctctcctccagaattcc

SEQ ID NO: 1264 - DNA, 20 bp, Synthetic construct
  source 1..20: mol_type = other DNA
ctactaactttaattctctt

SEQ ID NO: 1265 - DNA, 20 bp, Synthetic construct
  source 1..20: mol_type = other DNA
cttcccattcccctggtagt

SEQ ID NO: 1266 - DNA, 20 bp, Synthetic construct
  source 1..20: mol_type = other DNA
gtcttacttttcttgatagt

SEQ ID NO: 1267 - DNA, 20 bp, Synthetic construct
  source 1..20: mol_type = other DNA
ttggactccttaatgacctg

SEQ ID NO: 1268 - DNA, 20 bp, Synthetic construct
  source 1..20: mol_type = other DNA
tccataacaacaggaatcag

SEQ ID NO: 1269 - DNA, 20 bp, Synthetic construct
  source 1..20: mol_type = other DNA
tggcaacagtttccataaca

SEQ ID NO: 1270 - DNA, 20 bp, Synthetic construct
  source 1..20: mol_type = other DNA
ctccatctctggcaacagtt

SEQ ID NO: 1271 - DNA, 20 bp, Synthetic construct
  source 1..20: mol_type = other DNA
agttcccagatactccgaga

SEQ ID NO: 1272 - DNA, 20 bp, Synthetic construct
  source 1..20: mol_type = other DNA
ctcaaaggcacagttcccag

SEQ ID NO: 1273 - DNA, 20 bp, Synthetic construct
  source 1..20: mol_type = other DNA
tttcctccagcagcctgagg

SEQ ID NO: 1274 - DNA, 20 bp, Synthetic construct
  source 1..20: mol_type = other DNA
gagtctcagttttcctccag

SEQ ID NO: 1275 - DNA, 20 bp, Synthetic construct
  source 1..20: mol_type = other DNA
gaatcaagctcccacctgcc

SEQ ID NO: 1276 - DNA, 20 bp, Synthetic construct
  source 1..20: mol_type = other DNA
ctgagaatcaagctcccacc

SEQ ID NO: 1277 - DNA, 20 bp, Synthetic construct
  source 1..20: mol_type = other DNA
ttttcctcagcgactaaagg

SEQ ID NO: 1278 - DNA, 20 bp, Synthetic construct
  source 1..20: mol_type = other DNA
ggcgcagcatttgtctttat

SEQ ID NO: 1279 - DNA, 20 bp, Synthetic construct
  source 1..20: mol_type = other DNA
atatcttgtgaccttgtgat

SEQ ID NO: 1280 - DNA, 20 bp, Synthetic construct
  source 1..20: mol_type = other DNA
tttgagatatcttgtgacct

SEQ ID NO: 1281 - DNA, 20 bp, Synthetic construct
  source 1..20: mol_type = other DNA
gaggcttttgagatatcttg

SEQ ID NO: 1282 - DNA, 20 bp, Synthetic construct
  source 1..20: mol_type = other DNA
attgtgaggcttttgagata

SEQ ID NO: 1283 - DNA, 20 bp, Synthetic construct
  source 1..20: mol_type = other DNA
gacccaagtccttggccttg

SEQ ID NO: 1284 - DNA, 20 bp, Synthetic construct
  source 1..20: mol_type = other DNA
tttggagggtgacccaagtc

SEQ ID NO: 1285 - DNA, 20 bp, Synthetic construct
  source 1..20: mol_type = other DNA
ctcttagtttggagggtgac

SEQ ID NO: 1286 - DNA, 20 bp, Synthetic construct
  source 1..20: mol_type = other DNA
ccttttaccaagctggaaat

SEQ ID NO: 1287 - DNA, 20 bp, Synthetic construct
  source 1..20: mol_type = other DNA
gtagtttccttttaccaagc

SEQ ID NO: 1288 - DNA, 20 bp, Synthetic construct
  source 1..20: mol_type = other DNA
gagacttctcgggcactcct

SEQ ID NO: 1289 - DNA, 20 bp, Synthetic construct
  source 1..20: mol_type = other DNA
tgggcctgtttctggtccct

SEQ ID NO: 1290 - DNA, 20 bp, Synthetic construct
  source 1..20: mol_type = other DNA
ttccccagtagggaggtgct

SEQ ID NO: 1291 - DNA, 20 bp, Synthetic construct
  source 1..20: mol_type = other DNA
ataggtgagctcgctgccca

SEQ ID NO: 1292 - DNA, 20 bp, Synthetic construct
  source 1..20: mol_type = other DNA
cacaggctcagaataggtga

SEQ ID NO: 1293 - DNA, 20 bp, Synthetic construct
  source 1..20: mol_type = other DNA
caagtcaaagtaacttgatg

SEQ ID NO: 1294 - DNA, 20 bp, Synthetic construct
  source 1..20: mol_type = other DNA
tgaattttattatgaccacc

SEQ ID NO: 1295 - DNA, 20 bp, Synthetic construct
  source 1..20: mol_type = other DNA
catgtcctgtcagctcagtg

SEQ ID NO: 1296 - DNA, 20 bp, Synthetic construct
  source 1..20: mol_type = other DNA
cacaagcatacactcactgt

SEQ ID NO: 1297 - DNA, 20 bp, Synthetic construct
  source 1..20: mol_type = other DNA
cagggttggtgcacctgctt

SEQ ID NO: 1298 - DNA, 20 bp, Synthetic construct
  source 1..20: mol_type = other DNA
tagacagaggacttgtctgg

SEQ ID NO: 1299 - DNA, 20 bp, Synthetic construct
  source 1..20: mol_type = other DNA
cccttgaggcagctgtcaca

SEQ ID NO: 1300 - DNA, 20 bp, Synthetic construct
  source 1..20: mol_type = other DNA
cattgctctggcgggctgag

SEQ ID NO: 1301 - DNA, 20 bp, Synthetic construct
  source 1..20: mol_type = other DNA
caatctctgtgttgagcttt

SEQ ID NO: 1302 - DNA, 20 bp, Synthetic construct
  source 1..20: mol_type = other DNA
tcatttcctgtctctacctg

SEQ ID NO: 1303 - DNA, 20 bp, Synthetic construct
  source 1..20: mol_type = other DNA
gaccagggtgagagaagcgg

SEQ ID NO: 1304 - DNA, 20 bp, Synthetic construct
  source 1..20: mol_type = other DNA
gaggaggcaggctggcccac

SEQ ID NO: 1305 - DNA, 20 bp, Synthetic construct
  source 1..20: mol_type = other DNA
aataatgggtacttttgaaa

SEQ ID NO: 1306 - DNA, 20 bp, Synthetic construct
  source 1..20: mol_type = other DNA
ttcatagtaaggtaatccat

SEQ ID NO: 1307 - DNA, 20 bp, Synthetic construct
  source 1..20: mol_type = other DNA
cctctctggacttcggctct

SEQ ID NO: 1308 - DNA, 20 bp, Synthetic construct
  source 1..20: mol_type = other DNA
ggcactatgtttgggtgcac

SEQ ID NO: 1309 - DNA, 20 bp, Synthetic construct
  source 1..20: mol_type = other DNA
tctacagtgtctttcctggc

SEQ ID NO: 1310 - DNA, 20 bp, Synthetic construct
  source 1..20: mol_type = other DNA
ctaggtgccctggctaggct

SEQ ID NO: 1311 - DNA, 20 bp, Synthetic construct
  source 1..20: mol_type = other DNA
tgcagggaggtcctcccagc

SEQ ID NO: 1312 - DNA, 20 bp, Synthetic construct
  source 1..20: mol_type = other DNA
gcgagcggaggcctgggtgt

SEQ ID NO: 1313 - DNA, 20 bp, Synthetic construct
  source 1..20: mol_type = other DNA
actgacagctgcatctgcgg

SEQ ID NO: 1314 - DNA, 20 bp, Synthetic construct
  source 1..20: mol_type = other DNA
aagcgaatgaatgaacagtg

SEQ ID NO: 1315 - DNA, 20 bp, Synthetic construct
  source 1..20: mol_type = other DNA
cctggctgggacttttccca

SEQ ID NO: 1316 - DNA, 20 bp, Synthetic construct
  source 1..20: mol_type = other DNA
gggaggtgagcagcacccca

SEQ ID NO: 1317 - DNA, 20 bp, Synthetic construct
  source 1..20: mol_type = other DNA
tggccgtccctgctccgccc

SEQ ID NO: 1318 - DNA, 20 bp, Synthetic construct
  source 1..20: mol_type = other DNA
ggccggtcccgcggagcccc

SEQ ID NO: 1319 - DNA, 20 bp, Synthetic construct
  source 1..20: mol_type = other DNA
gggatggagccggccggtcc

SEQ ID NO: 1320 - DNA, 20 bp, Synthetic construct
  source 1..20: mol_type = other DNA
agcagggagacttccccagg

SEQ ID NO: 1321 - DNA, 20 bp, Synthetic construct
  source 1..20: mol_type = other DNA
actcagtccctgaagggagc

SEQ ID NO: 1322 - DNA, 20 bp, Synthetic construct
  source 1..20: mol_type = other DNA
ctgctatgtgtgaggcaggc

SEQ ID NO: 1323 - DNA, 20 bp, Synthetic construct
  source 1..20: mol_type = other DNA
caatcttggctgggaagatg

SEQ ID NO: 1324 - DNA, 20 bp, Synthetic construct
  source 1..20: mol_type = other DNA
agatgggtgaggtgaggagt

SEQ ID NO: 1325 - DNA, 20 bp, Synthetic construct
  source 1..20: mol_type = other DNA
ccttttccttgccaggaaag

SEQ ID NO: 1326 - DNA, 20 bp, Synthetic construct
  source 1..20: mol_type = other DNA
agtaatttagctcccccctc

SEQ ID NO: 1327 - DNA, 20 bp, Synthetic construct
  source 1..20: mol_type = other DNA
agaatcatttcagggccaat

SEQ ID NO: 1328 - DNA, 20 bp, Synthetic construct
  source 1..20: mol_type = other DNA
gaagaagaggaattttgttc

SEQ ID NO: 1329 - DNA, 20 bp, Synthetic construct
  source 1..20: mol_type = other DNA
ttaagtcctgagacatgcat

SEQ ID NO: 1330 - DNA, 20 bp, Synthetic construct
  source 1..20: mol_type = other DNA
tttctgatgctgaattaagt

SEQ ID NO: 1331 - DNA, 20 bp, Synthetic construct
  source 1..20: mol_type = other DNA
taggatttggcagtattacc

SEQ ID NO: 1332 - DNA, 20 bp, Synthetic construct
  source 1..20: mol_type = other DNA
tgtggcacatattagtgctc

SEQ ID NO: 1333 - DNA, 20 bp, Synthetic construct
  source 1..20: mol_type = other DNA
aatccccttactcgggagtc

SEQ ID NO: 1334 - DNA, 20 bp, Synthetic construct
  source 1..20: mol_type = other DNA
ttgaaatcaggagaccagga

SEQ ID NO: 1335 - DNA, 20 bp, Synthetic construct
  source 1..20: mol_type = other DNA
aaaacccagcacggtattga

SEQ ID NO: 1336 - DNA, 20 bp, Synthetic construct
  source 1..20: mol_type = other DNA
ccgagcagagagagcctagg

SEQ ID NO: 1337 - DNA, 20 bp, Synthetic construct
  source 1..20: mol_type = other DNA
catggactttcagggcatga

SEQ ID NO: 1338 - DNA, 20 bp, Synthetic construct
  source 1..20: mol_type = other DNA
cagcctatggagggactgag

SEQ ID NO: 1339 - DNA, 20 bp, Synthetic construct
  source 1..20: mol_type = other DNA
aagagagagtgtgtattagg

SEQ ID NO: 1340 - DNA, 20 bp, Synthetic construct
  source 1..20: mol_type = other DNA
tttctctccctggcaagcaa

SEQ ID NO: 1341 - DNA, 20 bp, Synthetic construct
  source 1..20: mol_type = other DNA
aactgtgtctgctagagttg

SEQ ID NO: 1342 - DNA, 20 bp, Synthetic construct
  source 1..20: mol_type = other DNA
gtaagctgctggagtaagat

SEQ ID NO: 1343 - DNA, 20 bp, Synthetic construct
  source 1..20: mol_type = other DNA
atagtaaccacagctgcctt

SEQ ID NO: 1344 - DNA, 20 bp, Synthetic construct
  source 1..20: mol_type = other DNA
gtaaccttgggaagtccccg

SEQ ID NO: 1345 - DNA, 20 bp, Synthetic construct
  source 1..20: mol_type = other DNA
gtttccataacaacaggaat

SEQ ID NO: 1346 - DNA, 20 bp, Synthetic construct
  source 1..20: mol_type = other DNA
ctggcaacagtttccataac

SEQ ID NO: 1347 - DNA, 20 bp, Synthetic construct
  source 1..20: mol_type = other DNA
cagatactccgagagaacct

SEQ ID NO: 1348 - DNA, 20 bp, Synthetic construct
  source 1..20: mol_type = other DNA
cagttcccagatactccgag

SEQ ID NO: 1349 - DNA, 20 bp, Synthetic construct
  source 1..20: mol_type = other DNA
aaactcaaaggcacagttcc

SEQ ID NO: 1350 - DNA, 20 bp, Synthetic construct
  source 1..20: mol_type = other DNA
ttttcctccagcagcctgag

SEQ ID NO: 1351 - DNA, 20 bp, Synthetic construct
  source 1..20: mol_type = other DNA
tgagtctcagttttcctcca

SEQ ID NO: 1352 - DNA, 20 bp, Synthetic construct
  source 1..20: mol_type = other DNA
agaatcaagctcccacctgc

SEQ ID NO: 1353 - DNA, 20 bp, Synthetic construct
  source 1..20: mol_type = other DNA
tcctcagcgactaaaggcag

SEQ ID NO: 1354 - DNA, 20 bp, Synthetic construct
  source 1..20: mol_type = other DNA
atttttcctcagcgactaaa

SEQ ID NO: 1355 - DNA, 20 bp, Synthetic construct
  source 1..20: mol_type = other DNA
agggcgcagcatttgtcttt

SEQ ID NO: 1356 - DNA, 20 bp, Synthetic construct
  source 1..20: mol_type = other DNA
gagatatcttgtgaccttgt

SEQ ID NO: 1357 - DNA, 20 bp, Synthetic construct
  source 1..20: mol_type = other DNA
ttttgagatatcttgtgacc

SEQ ID NO: 1358 - DNA, 20 bp, Synthetic construct
  source 1..20: mol_type = other DNA
tgaggcttttgagatatctt

SEQ ID NO: 1359 - DNA, 20 bp, Synthetic construct
  source 1..20: mol_type = other DNA
tattgtgaggcttttgagat

SEQ ID NO: 1360 - DNA, 20 bp, Synthetic construct
  source 1..20: mol_type = other DNA
ggtgacccaagtccttggcc

SEQ ID NO: 1361 - DNA, 20 bp, Synthetic construct
  source 1..20: mol_type = other DNA
gtttggagggtgacccaagt

SEQ ID NO: 1362 - DNA, 20 bp, Synthetic construct
  source 1..20: mol_type = other DNA
accaagctggaaatggaaag

SEQ ID NO: 1363 - DNA, 20 bp, Synthetic construct
  source 1..20: mol_type = other DNA
tccttttaccaagctggaaa

SEQ ID NO: 1364 - DNA, 20 bp, Synthetic construct
  source 1..20: mol_type = other DNA
ggtagtttccttttaccaag

SEQ ID NO: 1365 - DNA, 20 bp, Synthetic construct
  source 1..20: mol_type = other DNA
ctgagacttctcgggcactc

SEQ ID NO: 1366 - DNA, 20 bp, Synthetic construct
  source 1..20: mol_type = other DNA
ggcatgcgggcatcagatcc

SEQ ID NO: 1367 - DNA, 20 bp, Synthetic construct
  source 1..20: mol_type = other DNA
ctcctgcactgctttcccca

SEQ ID NO: 1368 - DNA, 20 bp, Synthetic construct
  source 1..20: mol_type = other DNA
gaataggtgagctcgctgcc

SEQ ID NO: 1369 - DNA, 20 bp, Synthetic construct
  source 1..20: mol_type = other DNA
atatggacacaggctcagaa

SEQ ID NO: 1370 - DNA, 20 bp, Synthetic construct
  source 1..20: mol_type = other DNA
ctgtgcaagtcaaagtaact

SEQ ID NO: 1371 - DNA, 20 bp, Synthetic construct
  source 1..20: mol_type = other DNA
atgaattttattatgaccac

SEQ ID NO: 1372 - DNA, 20 bp, Synthetic construct
  source 1..20: mol_type = other DNA
acttgaaggcacacatgcat

SEQ ID NO: 1373 - DNA, 20 bp, Synthetic construct
  source 1..20: mol_type = other DNA
caggcgcatccacaagcata

SEQ ID NO: 1374 - DNA, 20 bp, Synthetic construct
  source 1..20: mol_type = other DNA
ctggaggatgagcagatgtg

SEQ ID NO: 1375 - DNA, 20 bp, Synthetic construct
  source 1..20: mol_type = other DNA
agcagcaggaggattaaggg

SEQ ID NO: 1376 - DNA, 20 bp, Synthetic construct
  source 1..20: mol_type = other DNA
tcccttgaggcagctgtcac

SEQ ID NO: 1377 - DNA, 20 bp, Synthetic construct
  source 1..20: mol_type = other DNA
ggagcagcacattgctctgg

SEQ ID NO: 1378 - DNA, 20 bp, Synthetic construct
  source 1..20: mol_type = other DNA
ttgcaatctctgtgttgagc

SEQ ID NO: 1379 - DNA, 20 bp, Synthetic construct
  source 1..20: mol_type = other DNA
agttcgaatgctctcttgtc

SEQ ID NO: 1380 - DNA, 20 bp, Synthetic construct
  source 1..20: mol_type = other DNA
accttggagcggtaccactc

SEQ ID NO: 1381 - DNA, 20 bp, Synthetic construct
  source 1..20: mol_type = other DNA
tcagtcacctggagaggata

SEQ ID NO: 1382 - DNA, 20 bp, Synthetic construct
  source 1..20: mol_type = other DNA
agcaatagtagcagtaataa

SEQ ID NO: 1383 - DNA, 20 bp, Synthetic construct
  source 1..20: mol_type = other DNA
cttcatagtaaggtaatcca

SEQ ID NO: 1384 - DNA, 20 bp, Synthetic construct
  source 1..20: mol_type = other DNA
atggaatgcaggctcccaag

SEQ ID NO: 1385 - DNA, 20 bp, Synthetic construct
  source 1..20: mol_type = other DNA
tgttctctacgggcactatg

SEQ ID NO: 1386 - DNA, 20 bp, Synthetic construct
  source 1..20: mol_type = other DNA
ccactaggaatggccctccc

SEQ ID NO: 1387 - DNA, 20 bp, Synthetic construct
  source 1..20: mol_type = other DNA
ctcagctaggtgccctggct

SEQ ID NO: 1388 - DNA, 20 bp, Synthetic construct
  source 1..20: mol_type = other DNA
cctcaccctgggttctaata

SEQ ID NO: 1389 - DNA, 20 bp, Synthetic construct
  source 1..20: mol_type = other DNA
aggcgagcggaggcctgggt

SEQ ID NO: 1390 - DNA, 20 bp, Synthetic construct
  source 1..20: mol_type = other DNA
acactgacagctgcatctgc

SEQ ID NO: 1391 - DNA, 20 bp, Synthetic construct
  source 1..20: mol_type = other DNA
cacctggtcagcaagcgaat

SEQ ID NO: 1392 - DNA, 20 bp, Synthetic construct
  source 1..20: mol_type = other DNA
ggccctggctgggacttttc

SEQ ID NO: 1393 - DNA, 20 bp, Synthetic construct
  source 1..20: mol_type = other DNA
aaatcagggaggtgagcagc

SEQ ID NO: 1394 - DNA, 20 bp, Synthetic construct
  source 1..20: mol_type = other DNA
cttctcccctggcatctcct

SEQ ID NO: 1395 - DNA, 20 bp, Synthetic construct
  source 1..20: mol_type = other DNA
tggagccggccggtcccgcg

SEQ ID NO: 1396 - DNA, 20 bp, Synthetic construct
  source 1..20: mol_type = other DNA
tgagggctcaccggttctcc

SEQ ID NO: 1397 - DNA, 20 bp, Synthetic construct
  source 1..20: mol_type = other DNA
aggcagcagggagacttccc

SEQ ID NO: 1398 - DNA, 20 bp, Synthetic construct
  source 1..20: mol_type = other DNA
aagggatctgcacacaaggc

SEQ ID NO: 1399 - DNA, 20 bp, Synthetic construct
  source 1..20: mol_type = other DNA
tcagtcatcaaacatctagt

SEQ ID NO: 1400 - DNA, 20 bp, Synthetic construct
  source 1..20: mol_type = other DNA
ccaatcttggctgggaagat

SEQ ID NO: 1401 - DNA, 20 bp, Synthetic construct
  source 1..20: mol_type = other DNA
aagagatgggtgaggtgagg

SEQ ID NO: 1402 - DNA, 20 bp, Synthetic construct
  source 1..20: mol_type = other DNA
taggctgggtcttggtgcgg

SEQ ID NO: 1403 - DNA, 20 bp, Synthetic construct
  source 1..20: mol_type = other DNA
aagtaatttagctcccccct

SEQ ID NO: 1404 - DNA, 20 bp, Synthetic construct
  source 1..20: mol_type = other DNA
aagaatcatttcagggccaa

SEQ ID NO: 1405 - DNA, 20 bp, Synthetic construct
  source 1..20: mol_type = other DNA
cagaagaagaggaattttgt

SEQ ID NO: 1406 - DNA, 20 bp, Synthetic construct
  source 1..20: mol_type = other DNA
attaagtcctgagacatgca

SEQ ID NO: 1407 - DNA, 20 bp, Synthetic construct
  source 1..20: mol_type = other DNA
cctttctgatgctgaattaa

SEQ ID NO: 1408 - DNA, 20 bp, Synthetic construct
  source 1..20: mol_type = other DNA
gtgactatctaggatttggc

SEQ ID NO: 1409 - DNA, 20 bp, Synthetic construct
  source 1..20: mol_type = other DNA
gaggagacaattaactaaaa

SEQ ID NO: 1410 - DNA, 20 bp, Synthetic construct
  source 1..20: mol_type = other DNA
tcgaaagcaggcaagcaagc

SEQ ID NO: 1411 - DNA, 20 bp, Synthetic construct
  source 1..20: mol_type = other DNA
attgaaatcaggagaccagg

SEQ ID NO: 1412 - DNA, 20 bp, Synthetic construct
  source 1..20: mol_type = other DNA
catttcagcccctctgcaag

SEQ ID NO: 1413 - DNA, 20 bp, Synthetic construct
  source 1..20: mol_type = other DNA
cctatgcaaccgagcagaga

SEQ ID NO: 1414 - DNA, 20 bp, Synthetic construct
  source 1..20: mol_type = other DNA
gtgtccaggctggtttctgc

SEQ ID NO: 1415 - DNA, 20 bp, Synthetic construct
  source 1..20: mol_type = other DNA
accaaggctccccttagaac

SEQ ID NO: 1416 - DNA, 20 bp, Synthetic construct
  source 1..20: mol_type = other DNA
aaagagagagtgtgtattag

SEQ ID NO: 1417 - DNA, 20 bp, Synthetic construct
  source 1..20: mol_type = other DNA
tctttctctccctggcaagc

SEQ ID NO: 1418 - DNA, 20 bp, Synthetic construct
  source 1..20: mol_type = other DNA
tggaaatggaaagccctccc

SEQ ID NO: 1419 - DNA, 20 bp, Synthetic construct
  source 1..20: mol_type = other DNA
gagtggtaagctgctggagt

SEQ ID NO: 1420 - DNA, 20 bp, Synthetic construct
  source 1..20: mol_type = other DNA
tgatagtaaccacagctgcc

SEQ ID NO: 1421 - DNA, 20 bp, Synthetic construct
  source 1..20: mol_type = other DNA
gtgtaaccttgggaagtccc

SEQ ID NO: 1422 - DNA, 20 bp, Synthetic construct
  source 1..20: mol_type = other DNA
cagtttccataacaacagga

SEQ ID NO: 1423 - DNA, 20 bp, Synthetic construct
  source 1..20: mol_type = other DNA
ctctggcaacagtttccata

SEQ ID NO: 1424 - DNA, 20 bp, Synthetic construct
  source 1..20: mol_type = other DNA
tcccagatactccgagagaa

SEQ ID NO: 1425 - DNA, 20 bp, Synthetic construct
  source 1..20: mol_type = other DNA
aggcacagttcccagatact

SEQ ID NO: 1426 - DNA, 20 bp, Synthetic construct
  source 1..20: mol_type = other DNA
tcctccagcagcctgaggaa

SEQ ID NO: 1427 - DNA, 20 bp, Synthetic construct
  source 1..20: mol_type = other DNA
gttttcctccagcagcctga

SEQ ID NO: 1428 - DNA, 20 bp, Synthetic construct
  source 1..20: mol_type = other DNA
aagctcccacctgcccacag

SEQ ID NO: 1429 - DNA, 20 bp, Synthetic construct
  source 1..20: mol_type = other DNA
gagaatcaagctcccacctg

SEQ ID NO: 1430 - DNA, 20 bp, Synthetic construct
  source 1..20: mol_type = other DNA
ttcctcagcgactaaaggca

SEQ ID NO: 1431 - DNA, 20 bp, Synthetic construct
  source 1..20: mol_type = other DNA
tatttttcctcagcgactaa

SEQ ID NO: 1432 - DNA, 20 bp, Synthetic construct
  source 1..20: mol_type = other DNA
gaagggcgcagcatttgtct

SEQ ID NO: 1433 - DNA, 20 bp, Synthetic construct
  source 1..20: mol_type = other DNA
tgagatatcttgtgaccttg

SEQ ID NO: 1434 - DNA, 20 bp, Synthetic construct
  source 1..20: mol_type = other DNA
cttttgagatatcttgtgac

SEQ ID NO: 1435 - DNA, 20 bp, Synthetic construct
  source 1..20: mol_type = other DNA
tgtgaggcttttgagatatc

SEQ ID NO: 1436 - DNA, 20 bp, Synthetic construct
  source 1..20: mol_type = other DNA
cgtattgtgaggcttttgag

SEQ ID NO: 1437 - DNA, 20 bp, Synthetic construct
  source 1..20: mol_type = other DNA
gggtgacccaagtccttggc

SEQ ID NO: 1438 - DNA, 20 bp, Synthetic construct
  source 1..20: mol_type = other DNA
agtttggagggtgacccaag

SEQ ID NO: 1439 - DNA, 20 bp, Synthetic construct
  source 1..20: mol_type = other DNA
tttaccaagctggaaatgga

SEQ ID NO: 1440 - DNA, 20 bp, Synthetic construct
  source 1..20: mol_type = other DNA
ttccttttaccaagctggaa

SEQ ID NO: 1441 - DNA, 20 bp, Synthetic construct
  source 1..20: mol_type = other DNA
tcccctggtagtttcctttt

SEQ ID NO: 1442 - DNA, 20 bp, Synthetic construct
  source 1..20: mol_type = other DNA
cagggaggttcggcccctcc

SEQ ID NO: 1443 - DNA, 20 bp, Synthetic construct
  source 1..20: mol_type = other DNA
ctcctggcagaaggcatgcg

SEQ ID NO: 1444 - DNA, 20 bp, Synthetic construct
  source 1..20: mol_type = other DNA
ggccccgctgctcctgcact

SEQ ID NO: 1445 - DNA, 20 bp, Synthetic construct
  source 1..20: mol_type = other DNA
cagaataggtgagctcgctg

SEQ ID NO: 1446 - DNA, 20 bp, Synthetic construct
  source 1..20: mol_type = other DNA
tttatatggacacaggctca

SEQ ID NO: 1447 - DNA, 20 bp, Synthetic construct
  source 1..20: mol_type = other DNA
tatgaccaccgcttcacagc

SEQ ID NO: 1448 - DNA, 20 bp, Synthetic construct
  source 1..20: mol_type = other DNA
ctgtcagctcagtgaagcgc

SEQ ID NO: 1449 - DNA, 20 bp, Synthetic construct
  source 1..20: mol_type = other DNA
cactcactgttgcacacaca

SEQ ID NO: 1450 - DNA, 20 bp, Synthetic construct
  source 1..20: mol_type = other DNA
acacaggcgcatccacaagc

SEQ ID NO: 1451 - DNA, 20 bp, Synthetic construct
  source 1..20: mol_type = other DNA
gacttgtctggaggatgagc

SEQ ID NO: 1452 - DNA, 20 bp, Synthetic construct
  source 1..20: mol_type = other DNA
cagtagagcagcaggaggat

SEQ ID NO: 1453 - DNA, 20 bp, Synthetic construct
  source 1..20: mol_type = other DNA
ggacacattcctgggtccag

SEQ ID NO: 1454 - DNA, 20 bp, Synthetic construct
  source 1..20: mol_type = other DNA
ggtgaggagtagagggccac

SEQ ID NO: 1455 - DNA, 20 bp, Synthetic construct
  source 1..20: mol_type = other DNA
tctctcagttgcaatctctg

SEQ ID NO: 1456 - DNA, 20 bp, Synthetic construct
  source 1..20: mol_type = other DNA
gagttcgaatgctctcttgt

SEQ ID NO: 1457 - DNA, 20 bp, Synthetic construct
  source 1..20: mol_type = other DNA
cccacaggcagggctacctt

SEQ ID NO: 1458 - DNA, 20 bp, Synthetic construct
  source 1..20: mol_type = other DNA
tacttttgaaagcaatagtg

SEQ ID NO: 1459 - DNA, 20 bp, Synthetic construct
  source 1..20: mol_type = other DNA
cttagaacagaacagtatca

SEQ ID NO: 1460 - DNA, 20 bp, Synthetic construct
  source 1..20: mol_type = other DNA
tctggacttcggctctctca

SEQ ID NO: 1461 - DNA, 20 bp, Synthetic construct
  source 1..20: mol_type = other DNA
aaacagactggcagaggcat

SEQ ID NO: 1462 - DNA, 20 bp, Synthetic construct
  source 1..20: mol_type = other DNA
gagctgtggtgttctctacg

SEQ ID NO: 1463 - DNA, 20 bp, Synthetic construct
  source 1..20: mol_type = other DNA
tgtcctccactaggaatggc

SEQ ID NO: 1464 - DNA, 20 bp, Synthetic construct
  source 1..20: mol_type = other DNA
tcacactcctcagctaggtg

SEQ ID NO: 1465 - DNA, 20 bp, Synthetic construct
  source 1..20: mol_type = other DNA
ggcctcaccctgggttctaa

SEQ ID NO: 1466 - DNA, 20 bp, Synthetic construct
  source 1..20: mol_type = other DNA
ttaggcgagcggaggcctgg

SEQ ID NO: 1467 - DNA, 20 bp, Synthetic construct
  source 1..20: mol_type = other DNA
cacactgacagctgcatctg

SEQ ID NO: 1468 - DNA, 20 bp, Synthetic construct
  source 1..20: mol_type = other DNA
gcacaacacctggtcagcaa

SEQ ID NO: 1469 - DNA, 20 bp, Synthetic construct
  source 1..20: mol_type = other DNA
gttggccctggctgggactt

SEQ ID NO: 1470 - DNA, 20 bp, Synthetic construct
  source 1..20: mol_type = other DNA
gaaatcagggaggtgagcag

SEQ ID NO: 1471 - DNA, 20 bp, Synthetic construct
  source 1..20: mol_type = other DNA
ggtttcgaggcccggccccc

SEQ ID NO: 1472 - DNA, 20 bp, Synthetic construct
  source 1..20: mol_type = other DNA
atggagccggccggtcccgc

SEQ ID NO: 1473 - DNA, 20 bp, Synthetic construct
  source 1..20: mol_type = other DNA
tgtgatgagggctcaccggt

SEQ ID NO: 1474 - DNA, 20 bp, Synthetic construct
  source 1..20: mol_type = other DNA
ctaccgtgaggcagcaggga

SEQ ID NO: 1475 - DNA, 20 bp, Synthetic construct
  source 1..20: mol_type = other DNA
tgtgctgggcattgaggtgg

SEQ ID NO: 1476 - DNA, 20 bp, Synthetic construct
  source 1..20: mol_type = other DNA
ggccttgaggcctaatcaat

SEQ ID NO: 1477 - DNA, 20 bp, Synthetic construct
  source 1..20: mol_type = other DNA
tgggtgaggtgaggagtcca

SEQ ID NO: 1478 - DNA, 20 bp, Synthetic construct
  source 1..20: mol_type = other DNA
aggcagaagagatgggtgag

SEQ ID NO: 1479 - DNA, 20 bp, Synthetic construct
  source 1..20: mol_type = other DNA
gccccgcccgagagagaaaa

SEQ ID NO: 1480 - DNA, 20 bp, Synthetic construct
  source 1..20: mol_type = other DNA
atcatttcagggccaatgca

SEQ ID NO: 1481 - DNA, 20 bp, Synthetic construct
  source 1..20: mol_type = other DNA
tgttccttagctaagaatca

SEQ ID NO: 1482 - DNA, 20 bp, Synthetic construct
  source 1..20: mol_type = other DNA
tccagaagaagaggaatttt

SEQ ID NO: 1483 - DNA, 20 bp, Synthetic construct
  source 1..20: mol_type = other DNA
aattaagtcctgagacatgc

SEQ ID NO: 1484 - DNA, 20 bp, Synthetic construct
  source 1..20: mol_type = other DNA
agtcagcctggttagccttt

SEQ ID NO: 1485 - DNA, 20 bp, Synthetic construct
  source 1..20: mol_type = other DNA
agtgacctgtgactatctag

SEQ ID NO: 1486 - DNA, 20 bp, Synthetic construct
  source 1..20: mol_type = other DNA
tctgccgaaggaaggaagga

SEQ ID NO: 1487 - DNA, 20 bp, Synthetic construct
  source 1..20: mol_type = other DNA
tccgtcgaaagcaggcaagc

SEQ ID NO: 1488 - DNA, 20 bp, Synthetic construct
  source 1..20: mol_type = other DNA
ggtattgaaatcaggagacc

SEQ ID NO: 1489 - DNA, 20 bp, Synthetic construct
  source 1..20: mol_type = other DNA
caatagtgctgctgccagag

SEQ ID NO: 1490 - DNA, 20 bp, Synthetic construct
  source 1..20: mol_type = other DNA
gaacctatgcaaccgagcag

SEQ ID NO: 1491 - DNA, 20 bp, Synthetic construct
  source 1..20: mol_type = other DNA
tatgtgccagccccaggctt

SEQ ID NO: 1492 - DNA, 20 bp, Synthetic construct
  source 1..20: mol_type = other DNA
tggtaccaaggctcccctta

SEQ ID NO: 1493 - DNA, 20 bp, Synthetic construct
  source 1..20: mol_type = other DNA
gcccccgagtttgagggtga

SEQ ID NO: 1494 - DNA, 20 bp, Synthetic construct
  source 1..20: mol_type = other DNA
gttggaagtgaaagctacta

SEQ ID NO: 1495 - DNA, 20 bp, Synthetic construct
  source 1..20: mol_type = other DNA
agctcccactgtggttggag

SEQ ID NO: 1496 - DNA, 20 bp, Synthetic construct
  source 1..20: mol_type = other DNA
tgcctggcgagtggtaagct

SEQ ID NO: 1497 - DNA, 20 bp, Synthetic construct
  source 1..20: mol_type = other DNA
cttgatagtaaccacagctg

SEQ ID NO: 1498 - DNA, 20 bp, Synthetic construct
  source 1..20: mol_type = other DNA
agttaggagttcacacagac

SEQ ID NO: 1499 - DNA, 20 bp, Synthetic construct
  source 1..20: mol_type = other DNA
gcaacagtttccataacaac

SEQ ID NO: 1500 - DNA, 20 bp, Synthetic construct
  source 1..20: mol_type = other DNA
catctctggcaacagtttcc

SEQ ID NO: 1501 - DNA, 20 bp, Synthetic construct
  source 1..20: mol_type = other DNA
gttcccagatactccgagag

SEQ ID NO: 1502 - DNA, 20 bp, Synthetic construct
  source 1..20: mol_type = other DNA
aaggcacagttcccagatac

SEQ ID NO: 1503 - DNA, 20 bp, Synthetic construct
  source 1..20: mol_type = other DNA
ttcctccagcagcctgagga

SEQ ID NO: 1504 - DNA, 20 bp, Synthetic construct
  source 1..20: mol_type = other DNA
agttttcctccagcagcctg

SEQ ID NO: 1505 - DNA, 20 bp, Synthetic construct
  source 1..20: mol_type = other DNA
atcaagctcccacctgccca

SEQ ID NO: 1506 - DNA, 20 bp, Synthetic construct
  source 1..20: mol_type = other DNA
tgagaatcaagctcccacct

SEQ ID NO: 1507 - DNA, 20 bp, Synthetic construct
  source 1..20: mol_type = other DNA
tttcctcagcgactaaaggc

SEQ ID NO: 1508 - DNA, 20 bp, Synthetic construct
  source 1..20: mol_type = other DNA
cgcagcatttgtctttattt

SEQ ID NO: 1509 - DNA, 20 bp, Synthetic construct
  source 1..20: mol_type = other DNA
ggaagggcgcagcatttgtc

SEQ ID NO: 1510 - DNA, 20 bp, Synthetic construct
  source 1..20: mol_type = other DNA
ttgagatatcttgtgacctt

SEQ ID NO: 1511 - DNA, 20 bp, Synthetic construct
  source 1..20: mol_type = other DNA
aggcttttgagatatcttgt

SEQ ID NO: 1512 - DNA, 20 bp, Synthetic construct
  source 1..20: mol_type = other DNA
ttgtgaggcttttgagatat

SEQ ID NO: 1513 - DNA, 20 bp, Synthetic construct
  source 1..20: mol_type = other DNA
ccaagtccttggccttgagg

SEQ ID NO: 1514 - DNA, 20 bp, Synthetic construct
  source 1..20: mol_type = other DNA
tggagggtgacccaagtcct

SEQ ID NO: 1515 - DNA, 20 bp, Synthetic construct
  source 1..20: mol_type = other DNA
ttagtttggagggtgaccca

SEQ ID NO: 1516 - DNA, 20 bp, Synthetic construct
  source 1..20: mol_type = other DNA
cttttaccaagctggaaatg

SEQ ID NO: 1517 - DNA, 20 bp, Synthetic construct
  source 1..20: mol_type = other DNA
tttccttttaccaagctgga

SEQ ID NO: 1518 - DNA, 20 bp, Synthetic construct
  source 1..20: mol_type = other DNA
tctcgggcactccttcttgg

SEQ ID NO: 1519 - DNA, 20 bp, Synthetic construct
  source 1..20: mol_type = other DNA
cccatcaagaggtagggagg

SEQ ID NO: 1520 - DNA, 20 bp, Synthetic construct
  source 1..20: mol_type = other DNA
gaccctggactcctggcaga

SEQ ID NO: 1521 - DNA, 20 bp, Synthetic construct
  source 1..20: mol_type = other DNA
ccagccatgaatgaaacaca

SEQ ID NO: 1522 - DNA, 20 bp, Synthetic construct
  source 1..20: mol_type = other DNA
ggctcagaataggtgagctc

SEQ ID NO: 1523 - DNA, 20 bp, Synthetic construct
  source 1..20: mol_type = other DNA
gtcacaagctggtggcaggc

SEQ ID NO: 1524 - DNA, 20 bp, Synthetic construct
  source 1..20: mol_type = other DNA
tttattatgaccaccgcttc

SEQ ID NO: 1525 - DNA, 20 bp, Synthetic construct
  source 1..20: mol_type = other DNA
atgtcctgtcagctcagtga

SEQ ID NO: 1526 - DNA, 20 bp, Synthetic construct
  source 1..20: mol_type = other DNA
catacactcactgttgcaca

SEQ ID NO: 1527 - DNA, 20 bp, Synthetic construct
  source 1..20: mol_type = other DNA
gtgcacctgcttctgctcac

SEQ ID NO: 1528 - DNA, 20 bp, Synthetic construct
  source 1..20: mol_type = other DNA
aggacttgtctggaggatga

SEQ ID NO: 1529 - DNA, 20 bp, Synthetic construct
  source 1..20: mol_type = other DNA
tgaggcagctgtcacagaga

SEQ ID NO: 1530 - DNA, 20 bp, Synthetic construct
  source 1..20: mol_type = other DNA
catcctggagcctggagtgg

SEQ ID NO: 1531 - DNA, 20 bp, Synthetic construct
  source 1..20: mol_type = other DNA
aatctctgtgttgagctttc

SEQ ID NO: 1532 - DNA, 20 bp, Synthetic construct
  source 1..20: mol_type = other DNA
ctctctcagttgcaatctct

SEQ ID NO: 1533 - DNA, 20 bp, Synthetic construct
  source 1..20: mol_type = other DNA
cggccaggagttcgaatgct

SEQ ID NO: 1534 - DNA, 20 bp, Synthetic construct
  source 1..20: mol_type = other DNA
tggcccacaggcagggctac

SEQ ID NO: 1535 - DNA, 20 bp, Synthetic construct
  source 1..20: mol_type = other DNA
tgggtacttttgaaagcaat

SEQ ID NO: 1536 - DNA, 20 bp, Synthetic construct
  source 1..20: mol_type = other DNA
aaaagcacagggcttagaac

SEQ ID NO: 1537 - DNA, 20 bp, Synthetic construct
  source 1..20: mol_type = other DNA
ctctctggacttcggctctc

SEQ ID NO: 1538 - DNA, 20 bp, Synthetic construct
  source 1..20: mol_type = other DNA
ggcatatggtagaggctcag

SEQ ID NO: 1539 - DNA, 20 bp, Synthetic construct
  source 1..20: mol_type = other DNA
tataagctctgagctgtggt

SEQ ID NO: 1540 - DNA, 20 bp, Synthetic construct
  source 1..20: mol_type = other DNA
ggtgccctggctaggctagc

SEQ ID NO: 1541 - DNA, 20 bp, Synthetic construct
  source 1..20: mol_type = other DNA
ctcacactcctcagctaggt

SEQ ID NO: 1542 - DNA, 20 bp, Synthetic construct
  source 1..20: mol_type = other DNA
gcggaggcctgggtgttttg

SEQ ID NO: 1543 - DNA, 20 bp, Synthetic construct
  source 1..20: mol_type = other DNA
gtcttaggcgagcggaggcc

SEQ ID NO: 1544 - DNA, 20 bp, Synthetic construct
  source 1..20: mol_type = other DNA
aacagtgccacagaatccag

SEQ ID NO: 1545 - DNA, 20 bp, Synthetic construct
  source 1..20: mol_type = other DNA
gacccatggatgcgggcagg

SEQ ID NO: 1546 - DNA, 20 bp, Synthetic construct
  source 1..20: mol_type = other DNA
cgttggccctggctgggact

SEQ ID NO: 1547 - DNA, 20 bp, Synthetic construct
  source 1..20: mol_type = other DNA
tctgtcaggtctgcaaacta

SEQ ID NO: 1548 - DNA, 20 bp, Synthetic construct
  source 1..20: mol_type = other DNA
gggaggtttcgaggcccggc

SEQ ID NO: 1549 - DNA, 20 bp, Synthetic construct
  source 1..20: mol_type = other DNA
ggatggagccggccggtccc

SEQ ID NO: 1550 - DNA, 20 bp, Synthetic construct
  source 1..20: mol_type = other DNA
gctgtgatgagggctcaccg

SEQ ID NO: 1551 - DNA, 20 bp, Synthetic construct
  source 1..20: mol_type = other DNA
ctgaagggagcaagatgagc

SEQ ID NO: 1552 - DNA, 20 bp, Synthetic construct
  source 1..20: mol_type = other DNA
actgtgctgggcattgaggt

SEQ ID NO: 1553 - DNA, 20 bp, Synthetic construct
  source 1..20: mol_type = other DNA
gagtatgcctcttagtttgg

SEQ ID NO: 1554 - DNA, 20 bp, Synthetic construct
  source 1..20: mol_type = other DNA
atgggtgaggtgaggagtcc

SEQ ID NO: 1555 - DNA, 20 bp, Synthetic construct
  source 1..20: mol_type = other DNA
gtggtgaagaaagttccaag

SEQ ID NO: 1556 - DNA, 20 bp, Synthetic construct
  source 1..20: mol_type = other DNA
cgccccgcccgagagagaaa

SEQ ID NO: 1557 - DNA, 20 bp, Synthetic construct
  source 1..20: mol_type = other DNA
gaatcatttcagggccaatg

SEQ ID NO: 1558 - DNA, 20 bp, Synthetic construct
  source 1..20: mol_type = other DNA
tttgttccttagctaagaat

SEQ ID NO: 1559 - DNA, 20 bp, Synthetic construct
  source 1..20: mol_type = other DNA
agtccagaagaagaggaatt

SEQ ID NO: 1560 - DNA, 20 bp, Synthetic construct
  source 1..20: mol_type = other DNA
ctgatgctgaattaagtcct

SEQ ID NO: 1561 - DNA, 20 bp, Synthetic construct
  source 1..20: mol_type = other DNA
ctagtcagcctggttagcct

SEQ ID NO: 1562 - DNA, 20 bp, Synthetic construct
  source 1..20: mol_type = other DNA
ccatttatctgtgctttagt

SEQ ID NO: 1563 - DNA, 20 bp, Synthetic construct
  source 1..20: mol_type = other DNA
cgctctgccgaaggaaggaa

SEQ ID NO: 1564 - DNA, 20 bp, Synthetic construct
  source 1..20: mol_type = other DNA
aaatcaggagaccaggaggg

SEQ ID NO: 1565 - DNA, 20 bp, Synthetic construct
  source 1..20: mol_type = other DNA
cagcacggtattgaaatcag

SEQ ID NO: 1566 - DNA, 20 bp, Synthetic construct
  source 1..20: mol_type = other DNA
ttccaaacgggctggagagc

SEQ ID NO: 1567 - DNA, 20 bp, Synthetic construct
  source 1..20: mol_type = other DNA
atggactttcagggcatgag

SEQ ID NO: 1568 - DNA, 20 bp, Synthetic construct
  source 1..20: mol_type = other DNA
ggagggactgaggaaacgga

SEQ ID NO: 1569 - DNA, 20 bp, Synthetic construct
  source 1..20: mol_type = other DNA
gtgtgtattaggatcccatc

SEQ ID NO: 1570 - DNA, 20 bp, Synthetic construct
  source 1..20: mol_type = other DNA
agcaaggcccccgagtttga

SEQ ID NO: 1571 - DNA, 20 bp, Synthetic construct
  source 1..20: mol_type = other DNA
gctagagttggaagtgaaag

SEQ ID NO: 1572 - DNA, 20 bp, Synthetic construct
  source 1..20: mol_type = other DNA
atgagctcccactgtggttg

SEQ ID NO: 1573 - DNA, 20 bp, Synthetic construct
  source 1..20: mol_type = other DNA
gataacactgggaaagcatt

SEQ ID NO: 1574 - DNA, 20 bp, Synthetic construct
  source 1..20: mol_type = other DNA
aaccttgggaagtccccgac

SEQ ID NO: 1575 - DNA, 20 bp, Synthetic construct
  source 1..20: mol_type = other DNA
acagttaggagttcacacag

SEQ ID NO: 1576 - DNA, 20 bp, Synthetic construct
  source 1..20: mol_type = other DNA
ctggctctgctcgctcctgg

SEQ ID NO: 1577 - DNA, 20 bp, Synthetic construct
  source 1..20: mol_type = other DNA
ctccatcatctctgcccgct

SEQ ID NO: 1578 - DNA, 20 bp, Synthetic construct
  source 1..20: mol_type = other DNA
ctataggcagccaggttgtt

SEQ ID NO: 1579 - DNA, 20 bp, Synthetic construct
  source 1..20: mol_type = other DNA
atctctttcagggctgcggt

SEQ ID NO: 1580 - DNA, 20 bp, Synthetic construct
  source 1..20: mol_type = other DNA
tgaggctctgcccctcttcc

SEQ ID NO: 1581 - DNA, 20 bp, Synthetic construct
  source 1..20: mol_type = other DNA
ccttgtgctcctgcttggac

SEQ ID NO: 1582 - DNA, 20 bp, Synthetic construct
  source 1..20: mol_type = other DNA
aggcctgatactgacggagc

SEQ ID NO: 1583 - DNA, 20 bp, Synthetic construct
  source 1..20: mol_type = other DNA
gtaggtgccccccgccctcc

SEQ ID NO: 1584 - DNA, 20 bp, Synthetic construct
  source 1..20: mol_type = other DNA
agaacctccatctctggcaa

SEQ ID NO: 1585 - DNA, 20 bp, Synthetic construct
  source 1..20: mol_type = other DNA
ccaaaagacaaaacaagcct

SEQ ID NO: 1586 - DNA, 20 bp, Synthetic construct
  source 1..20: mol_type = other DNA
catagggatatcccacctca

SEQ ID NO: 1587 - DNA, 20 bp, Synthetic construct
  source 1..20: mol_type = other DNA
gtcatcgctcaggaggtcct

SEQ ID NO: 1588 - DNA, 20 bp, Synthetic construct
  source 1..20: mol_type = other DNA
ctatccctcccagcacctca

SEQ ID NO: 1589 - DNA, 20 bp, Synthetic construct
  source 1..20: mol_type = other DNA
aggatgagtcacttccttaa

SEQ ID NO: 1590 - DNA, 20 bp, Synthetic construct
  source 1..20: mol_type = other DNA
gtcatgccctgcccccatgg

SEQ ID NO: 1591 - DNA, 20 bp, Synthetic construct
  source 1..20: mol_type = other DNA
aggaagaggcctttagaaat

SEQ ID NO: 1592 - DNA, 20 bp, Synthetic construct
  source 1..20: mol_type = other DNA
gtgtgtgagtaagaagggac

SEQ ID NO: 1593 - DNA, 20 bp, Synthetic construct
  source 1..20: mol_type = other DNA
tcagttttacaattgtaaaa

SEQ ID NO: 1594 - DNA, 20 bp, Synthetic construct
  source 1..20: mol_type = other DNA
ggagaaccctgaagtgggcc

SEQ ID NO: 1595 - DNA, 20 bp, Synthetic construct
  source 1..20: mol_type = other DNA
gtattgtgaggcttttgaga

SEQ ID NO: 1596 - DNA, 20 bp, Synthetic construct
  source 1..20: mol_type = other DNA
gaggctcactccctgtcaag

SEQ ID NO: 1597 - DNA, 20 bp, Synthetic construct
  source 1..20: mol_type = other DNA
aacaagctctgccagtttaa

SEQ ID NO: 1598 - DNA, 20 bp, Synthetic construct
  source 1..20: mol_type = other DNA
tgagtcagcactgagctgag

SEQ ID NO: 1599 - DNA, 20 bp, Synthetic construct
  source 1..20: mol_type = other DNA
caagagctgcggtcctgagg

SEQ ID NO: 1600 - DNA, 20 bp, Synthetic construct
  source 1..20: mol_type = other DNA
tttaacattaagagcaggga

SEQ ID NO: 1601 - DNA, 20 bp, Synthetic construct
  source 1..20: mol_type = other DNA
ctggtatgataggctctggc

SEQ ID NO: 1602 - DNA, 20 bp, Synthetic construct
  source 1..20: mol_type = other DNA
cagacagggcagatgtcaag

SEQ ID NO: 1603 - DNA, 20 bp, Synthetic construct
  source 1..20: mol_type = other DNA
ccccttctgctcacaaggcc

SEQ ID NO: 1604 - DNA, 20 bp, Synthetic construct
  source 1..20: mol_type = other DNA
catgcgggcatcagatcccc

SEQ ID NO: 1605 - DNA, 20 bp, Synthetic construct
  source 1..20: mol_type = other DNA
tcgctgcccacagtcacaaa

SEQ ID NO: 1606 - DNA, 20 bp, Synthetic construct
  source 1..20: mol_type = other DNA
gtgctttgcgcccagacctg

SEQ ID NO: 1607 - DNA, 20 bp, Synthetic construct
  source 1..20: mol_type = other DNA
gaaatgaattttattatgac

SEQ ID NO: 1608 - DNA, 20 bp, Synthetic construct
  source 1..20: mol_type = other DNA
tccacaagcatacactcact

SEQ ID NO: 1609 - DNA, 20 bp, Synthetic construct
  source 1..20: mol_type = other DNA
tgcctcagtctcccttgagg

SEQ ID NO: 1610 - DNA, 20 bp, Synthetic construct
  source 1..20: mol_type = other DNA
ccattcctcagccttgcctt

SEQ ID NO: 1611 - DNA, 20 bp, Synthetic construct
  source 1..20: mol_type = other DNA
gtctctctcagtctcagctt

SEQ ID NO: 1612 - DNA, 20 bp, Synthetic construct
  source 1..20: mol_type = other DNA
gtctttctgtttgtctttca

SEQ ID NO: 1613 - DNA, 20 bp, Synthetic construct
  source 1..20: mol_type = other DNA
ccattgtgtcctcttctgcc

SEQ ID NO: 1614 - DNA, 20 bp, Synthetic construct
  source 1..20: mol_type = other DNA
ttctcttgtacagagcaaga

SEQ ID NO: 1615 - DNA, 20 bp, Synthetic construct
  source 1..20: mol_type = other DNA
ctgggcaagccatctcactt

SEQ ID NO: 1616 - DNA, 20 bp, Synthetic construct
  source 1..20: mol_type = other DNA
cagtatcagctactactaat

SEQ ID NO: 1617 - DNA, 20 bp, Synthetic construct
  source 1..20: mol_type = other DNA
aaggtaatccatgaaaagca

SEQ ID NO: 1618 - DNA, 20 bp, Synthetic construct
  source 1..20: mol_type = other DNA
gacttcggctctctcatctg

SEQ ID NO: 1619 - DNA, 20 bp, Synthetic construct
  source 1..20: mol_type = other DNA
ccaggtcagacacctctctg

SEQ ID NO: 1620 - DNA, 20 bp, Synthetic construct
  source 1..20: mol_type = other DNA
aagctctgagctgtggtgtt

SEQ ID NO: 1621 - DNA, 20 bp, Synthetic construct
  source 1..20: mol_type = other DNA
cccaaatgccccctctacag

SEQ ID NO: 1622 - DNA, 20 bp, Synthetic construct
  source 1..20: mol_type = other DNA
ccctgcctctctgtgctttt

SEQ ID NO: 1623 - DNA, 20 bp, Synthetic construct
  source 1..20: mol_type = other DNA
aggtcctcccagccccatcg

SEQ ID NO: 1624 - DNA, 20 bp, Synthetic construct
  source 1..20: mol_type = other DNA
tccacactgacagctgcatc

SEQ ID NO: 1625 - DNA, 20 bp, Synthetic construct
  source 1..20: mol_type = other DNA
tagcgggctgccagacctca

SEQ ID NO: 1626 - DNA, 20 bp, Synthetic construct
  source 1..20: mol_type = other DNA
ccctggccgcgctcaccgtg

SEQ ID NO: 1627 - DNA, 20 bp, Synthetic construct
  source 1..20: mol_type = other DNA
ttcaggccccgccctcgacc

SEQ ID NO: 1628 - DNA, 20 bp, Synthetic construct
  source 1..20: mol_type = other DNA
agggagcaagatgagctcta

SEQ ID NO: 1629 - DNA, 20 bp, Synthetic construct
  source 1..20: mol_type = other DNA
gaatccatccatccattcag

SEQ ID NO: 1630 - DNA, 20 bp, Synthetic construct
  source 1..20: mol_type = other DNA
ggtgaggagtccaatcttgg

SEQ ID NO: 1631 - DNA, 20 bp, Synthetic construct
  source 1..20: mol_type = other DNA
aagtggtgaagaaagttcca

SEQ ID NO: 1632 - DNA, 20 bp, Synthetic construct
  source 1..20: mol_type = other DNA
catcatgacaacttgaacgc

SEQ ID NO: 1633 - DNA, 20 bp, Synthetic construct
  source 1..20: mol_type = other DNA
cctccccccgccccgcccga

SEQ ID NO: 1634 - DNA, 20 bp, Synthetic construct
  source 1..20: mol_type = other DNA
gctaagaatcatttcagggc

SEQ ID NO: 1635 - DNA, 20 bp, Synthetic construct
  source 1..20: mol_type = other DNA
ctaaatattctagtccagaa

SEQ ID NO: 1636 - DNA, 20 bp, Synthetic construct
  source 1..20: mol_type = other DNA
tggttagcctttctgatgct

SEQ ID NO: 1637 - DNA, 20 bp, Synthetic construct
  source 1..20: mol_type = other DNA
ggcagtattacctctactag

SEQ ID NO: 1638 - DNA, 20 bp, Synthetic construct
  source 1..20: mol_type = other DNA
gtgacctgtgactatctagg

SEQ ID NO: 1639 - DNA, 20 bp, Synthetic construct
  source 1..20: mol_type = other DNA
tgccatttatctgtgcttta

SEQ ID NO: 1640 - DNA, 20 bp, Synthetic construct
  source 1..20: mol_type = other DNA
taaaggctgttaaacatgtg

SEQ ID NO: 1641 - DNA, 20 bp, Synthetic construct
  source 1..20: mol_type = other DNA
accagccacatgactctggg

SEQ ID NO: 1642 - DNA, 20 bp, Synthetic construct
  source 1..20: mol_type = other DNA
cacggtattgaaatcaggag

SEQ ID NO: 1643 - DNA, 20 bp, Synthetic construct
  source 1..20: mol_type = other DNA
ctgctgccagagtcctggct

SEQ ID NO: 1644 - DNA, 20 bp, Synthetic construct
  source 1..20: mol_type = other DNA
cacccccctccccatcatga

SEQ ID NO: 1645 - DNA, 20 bp, Synthetic construct
  source 1..20: mol_type = other DNA
agaggaggcctctcatggac

SEQ ID NO: 1646 - DNA, 20 bp, Synthetic construct
  source 1..20: mol_type = other DNA
aacggaattacattcagttt

SEQ ID NO: 1647 - DNA, 20 bp, Synthetic construct
  source 1..20: mol_type = other DNA
tattaggatcccatctagtg

SEQ ID NO: 1648 - DNA, 20 bp, Synthetic construct
  source 1..20: mol_type = other DNA
aaagctactaactttaattc

SEQ ID NO: 1649 - DNA, 20 bp, Synthetic construct
  source 1..20: mol_type = other DNA
caagctggaaatggaaagcc

SEQ ID NO: 1650 - DNA, 20 bp, Synthetic construct
  source 1..20: mol_type = other DNA
agtggtaagctgctggagta

SEQ ID NO: 1651 - DNA, 20 bp, Synthetic construct
  source 1..20: mol_type = other DNA
ccgacttcccaggtcttact

SEQ ID NO: 1652 - DNA, 20 bp, Synthetic construct
  source 1..20: mol_type = other DNA
atgcgagggctttatgaagg

SEQ ID NO: 1653 - DNA, 20 bp, Synthetic construct
  source 1..20: mol_type = other DNA
tctctgcccgctcactggcc

SEQ ID NO: 1654 - DNA, 20 bp, Synthetic construct
  source 1..20: mol_type = other DNA
tgttctcggcttccagcctc

SEQ ID NO: 1655 - DNA, 20 bp, Synthetic construct
  source 1..20: mol_type = other DNA
ctctttcagggctgcggtga

SEQ ID NO: 1656 - DNA, 20 bp, Synthetic construct
  source 1..20: mol_type = other DNA
ctcttcctccagccgcgcca

SEQ ID NO: 1657 - DNA, 20 bp, Synthetic construct
  source 1..20: mol_type = other DNA
tcctgcttggactccttaat

SEQ ID NO: 1658 - DNA, 20 bp, Synthetic construct
  source 1..20: mol_type = other DNA
cagcaagctgacctagggac

SEQ ID NO: 1659 - DNA, 20 bp, Synthetic construct
  source 1..20: mol_type = other DNA
ccccccgccctcctcccctt

SEQ ID NO: 1660 - DNA, 20 bp, Synthetic construct
  source 1..20: mol_type = other DNA
cctccatctctggcaacagt

SEQ ID NO: 1661 - DNA, 20 bp, Synthetic construct
  source 1..20: mol_type = other DNA
aaaagacaaaacaagcctct

SEQ ID NO: 1662 - DNA, 20 bp, Synthetic construct
  source 1..20: mol_type = other DNA
tagggatatcccacctcata

SEQ ID NO: 1663 - DNA, 20 bp, Synthetic construct
  source 1..20: mol_type = other DNA
caggtgactgccccaggtgg

SEQ ID NO: 1664 - DNA, 20 bp, Synthetic construct
  source 1..20: mol_type = other DNA
tccctcccagcacctcatcc

SEQ ID NO: 1665 - DNA, 20 bp, Synthetic construct
  source 1..20: mol_type = other DNA
atgagtcacttccttaattc

SEQ ID NO: 1666 - DNA, 20 bp, Synthetic construct
  source 1..20: mol_type = other DNA
tggatacatcccctttctct

SEQ ID NO: 1667 - DNA, 20 bp, Synthetic construct
  source 1..20: mol_type = other DNA
gaagaggcctttagaaatgg

SEQ ID NO: 1668 - DNA, 20 bp, Synthetic construct
  source 1..20: mol_type = other DNA
gtgagtaagaagggaccgca

SEQ ID NO: 1669 - DNA, 20 bp, Synthetic construct
  source 1..20: mol_type = other DNA
tacaattgtaaaatagggca

SEQ ID NO: 1670 - DNA, 20 bp, Synthetic construct
  source 1..20: mol_type = other DNA
accagtctgctcaccagtct

SEQ ID NO: 1671 - DNA, 20 bp, Synthetic construct
  source 1..20: mol_type = other DNA
gatatcttgtgaccttgtga

SEQ ID NO: 1672 - DNA, 20 bp, Synthetic construct
  source 1..20: mol_type = other DNA
ggctcactccctgtcaagct

SEQ ID NO: 1673 - DNA, 20 bp, Synthetic construct
  source 1..20: mol_type = other DNA
caagctctgccagtttaatg

SEQ ID NO: 1674 - DNA, 20 bp, Synthetic construct
  source 1..20: mol_type = other DNA
ctgagctgagcgatggagcc

SEQ ID NO: 1675 - DNA, 20 bp, Synthetic construct
  source 1..20: mol_type = other DNA
tgcggtcctgagggaagaat

SEQ ID NO: 1676 - DNA, 20 bp, Synthetic construct
  source 1..20: mol_type = other DNA
taacattaagagcagggaac

SEQ ID NO: 1677 - DNA, 20 bp, Synthetic construct
  source 1..20: mol_type = other DNA
agtgtcacgaaggcccccag

SEQ ID NO: 1678 - DNA, 20 bp, Synthetic construct
  source 1..20: mol_type = other DNA
ggaccagggcctagcaggac

SEQ ID NO: 1679 - DNA, 20 bp, Synthetic construct
  source 1..20: mol_type = other DNA
ctgctcacaaggcccccctt

SEQ ID NO: 1680 - DNA, 20 bp, Synthetic construct
  source 1..20: mol_type = other DNA
ggttcggcccctccctgaga

SEQ ID NO: 1681 - DNA, 20 bp, Synthetic construct
  source 1..20: mol_type = other DNA
gccatgaatgaaacacaggg

SEQ ID NO: 1682 - DNA, 20 bp, Synthetic construct
  source 1..20: mol_type = other DNA
cctgcctgctctttccctca

SEQ ID NO: 1683 - DNA, 20 bp, Synthetic construct
  source 1..20: mol_type = other DNA
aattttattatgaccaccgc

SEQ ID NO: 1684 - DNA, 20 bp, Synthetic construct
  source 1..20: mol_type = other DNA
aagcatacactcactgttgc

SEQ ID NO: 1685 - DNA, 20 bp, Synthetic construct
  source 1..20: mol_type = other DNA
cagctgtcacagagaccacc

SEQ ID NO: 1686 - DNA, 20 bp, Synthetic construct
  source 1..20: mol_type = other DNA
ttcctcagccttgccttacc

SEQ ID NO: 1687 - DNA, 20 bp, Synthetic construct
  source 1..20: mol_type = other DNA
tctcagttgcaatctctgtg

SEQ ID NO: 1688 - DNA, 20 bp, Synthetic construct
  source 1..20: mol_type = other DNA
tttcatttcctgtctctacc

SEQ ID NO: 1689 - DNA, 20 bp, Synthetic construct
  source 1..20: mol_type = other DNA
tgtcctcttctgcctgcccc

SEQ ID NO: 1690 - DNA, 20 bp, Synthetic construct
  source 1..20: mol_type = other DNA
caggcagggctaccttggag

SEQ ID NO: 1691 - DNA, 20 bp, Synthetic construct
  source 1..20: mol_type = other DNA
atctcacttctctggtgaaa

SEQ ID NO: 1692 - DNA, 20 bp, Synthetic construct
  source 1..20: mol_type = other DNA
ataatagcaatagtagcagt

SEQ ID NO: 1693 - DNA, 20 bp, Synthetic construct
  source 1..20: mol_type = other DNA
taatccatgaaaagcacagg

SEQ ID NO: 1694 - DNA, 20 bp, Synthetic construct
  source 1..20: mol_type = other DNA
tcggctctctcatctgtcaa

SEQ ID NO: 1695 - DNA, 20 bp, Synthetic construct
  source 1..20: mol_type = other DNA
tcagacacctctctgtgtcc

SEQ ID NO: 1696 - DNA, 20 bp, Synthetic construct
  source 1..20: mol_type = other DNA
ctgtggtgttctctacgggc

SEQ ID NO: 1697 - DNA, 20 bp, Synthetic construct
  source 1..20: mol_type = other DNA
caaatgccccctctacagtg

SEQ ID NO: 1698 - DNA, 20 bp, Synthetic construct
  source 1..20: mol_type = other DNA
ctctctgtgcttttctgcct

SEQ ID NO: 1699 - DNA, 20 bp, Synthetic construct
  source 1..20: mol_type = other DNA
atcgggccctcaccctgctc

SEQ ID NO: 1700 - DNA, 20 bp, Synthetic construct
  source 1..20: mol_type = other DNA
taggcgagcggaggcctggg

SEQ ID NO: 1701 - DNA, 20 bp, Synthetic construct
  source 1..20: mol_type = other DNA
gacctcagcacctagcacaa

SEQ ID NO: 1702 - DNA, 20 bp, Synthetic construct
  source 1..20: mol_type = other DNA
tcaccgtgccgcgcagagac

SEQ ID NO: 1703 - DNA, 20 bp, Synthetic construct
  source 1..20: mol_type = other DNA
gccccgccctcgacccaggt

SEQ ID NO: 1704 - DNA, 20 bp, Synthetic construct
  source 1..20: mol_type = other DNA
gatgagctctaccgtgaggc

SEQ ID NO: 1705 - DNA, 20 bp, Synthetic construct
  source 1..20: mol_type = other DNA
agtcatcaaacatctagtga

SEQ ID NO: 1706 - DNA, 20 bp, Synthetic construct
  source 1..20: mol_type = other DNA
gaggagtccaatcttggctg

SEQ ID NO: 1707 - DNA, 20 bp, Synthetic construct
  source 1..20: mol_type = other DNA
gtgaagaaagttccaaggag

SEQ ID NO: 1708 - DNA, 20 bp, Synthetic construct
  source 1..20: mol_type = other DNA
tttccttgccaggaaagtct

SEQ ID NO: 1709 - DNA, 20 bp, Synthetic construct
  source 1..20: mol_type = other DNA
ccccgccccgcccgagagag

SEQ ID NO: 1710 - DNA, 20 bp, Synthetic construct
  source 1..20: mol_type = other DNA
taagaatcatttcagggcca

SEQ ID NO: 1711 - DNA, 20 bp, Synthetic construct
  source 1..20: mol_type = other DNA
aatattctagtccagaagaa

SEQ ID NO: 1712 - DNA, 20 bp, Synthetic construct
  source 1..20: mol_type = other DNA
ttagcctttctgatgctgaa

SEQ ID NO: 1713 - DNA, 20 bp, Synthetic construct
  source 1..20: mol_type = other DNA
tattacctctactagtcagc

SEQ ID NO: 1714 - DNA, 20 bp, Synthetic construct
  source 1..20: mol_type = other DNA
gacctgtgactatctaggat

SEQ ID NO: 1715 - DNA, 20 bp, Synthetic construct
  source 1..20: mol_type = other DNA
catttatctgtgctttagtg

SEQ ID NO: 1716 - DNA, 20 bp, Synthetic construct
  source 1..20: mol_type = other DNA
gctgttaaacatgtggcaca

SEQ ID NO: 1717 - DNA, 20 bp, Synthetic construct
  source 1..20: mol_type = other DNA
cctacttctctaggtgggag

SEQ ID NO: 1718 - DNA, 20 bp, Synthetic construct
  source 1..20: mol_type = other DNA
cggtattgaaatcaggagac

SEQ ID NO: 1719 - DNA, 20 bp, Synthetic construct
  source 1..20: mol_type = other DNA
tttcagcccctctgcaagcc

SEQ ID NO: 1720 - DNA, 20 bp, Synthetic construct
  source 1..20: mol_type = other DNA
cctccccatcatgagtatga

SEQ ID NO: 1721 - DNA, 20 bp, Synthetic construct
  source 1..20: mol_type = other DNA
aggaggcctctcatggactt

SEQ ID NO: 1722 - DNA, 20 bp, Synthetic construct
  source 1..20: mol_type = other DNA
aattacattcagtttccttg

SEQ ID NO: 1723 - DNA, 20 bp, Synthetic construct
  source 1..20: mol_type = other DNA
ttaggatcccatctagtggc

SEQ ID NO: 1724 - DNA, 20 bp, Synthetic construct
  source 1..20: mol_type = other DNA
tactaactttaattctcttt

SEQ ID NO: 1725 - DNA, 20 bp, Synthetic construct
  source 1..20: mol_type = other DNA
aaatggaaagccctccccat

SEQ ID NO: 1726 - DNA, 20 bp, Synthetic construct
  source 1..20: mol_type = other DNA
tggtaagctgctggagtaag

SEQ ID NO: 1727 - DNA, 20 bp, Synthetic construct
  source 1..20: mol_type = other DNA
ttcccaggtcttacttttct

SEQ ID NO: 1728 - DNA, 20 bp, Synthetic construct
  source 1..20: mol_type = other DNA
ggctctgctcgctcctggga

SEQ ID NO: 1729 - DNA, 20 bp, Synthetic construct
  source 1..20: mol_type = other DNA
catcatctctgcccgctcac

SEQ ID NO: 1730 - DNA, 20 bp, Synthetic construct
  source 1..20: mol_type = other DNA
aggttgttctcggcttccag

SEQ ID NO: 1731 - DNA, 20 bp, Synthetic construct
  source 1..20: mol_type = other DNA
tctctttcagggctgcggtg

SEQ ID NO: 1732 - DNA, 20 bp, Synthetic construct
  source 1..20: mol_type = other DNA
cctcttcctccagccgcgcc

SEQ ID NO: 1733 - DNA, 20 bp, Synthetic construct
  source 1..20: mol_type = other DNA
cttgtgctcctgcttggact

SEQ ID NO: 1734 - DNA, 20 bp, Synthetic construct
  source 1..20: mol_type = other DNA
actgacggagcctagggcag

SEQ ID NO: 1735 - DNA, 20 bp, Synthetic construct
  source 1..20: mol_type = other DNA
aggtgccccccgccctcctc

SEQ ID NO: 1736 - DNA, 20 bp, Synthetic construct
  source 1..20: mol_type = other DNA
acctccatctctggcaacag

SEQ ID NO: 1737 - DNA, 20 bp, Synthetic construct
  source 1..20: mol_type = other DNA
caaaagacaaaacaagcctc

SEQ ID NO: 1738 - DNA, 20 bp, Synthetic construct
  source 1..20: mol_type = other DNA
atagggatatcccacctcat

SEQ ID NO: 1739 - DNA, 20 bp, Synthetic construct
  source 1..20: mol_type = other DNA
tcaggaggtccttctgggat

SEQ ID NO: 1740 - DNA, 20 bp, Synthetic construct
  source 1..20: mol_type = other DNA
tatccctcccagcacctcat

SEQ ID NO: 1741 - DNA, 20 bp, Synthetic construct
  source 1..20: mol_type = other DNA
gatgagtcacttccttaatt

SEQ ID NO: 1742 - DNA, 20 bp, Synthetic construct
  source 1..20: mol_type = other DNA
tcatgccctgcccccatgga

SEQ ID NO: 1743 - DNA, 20 bp, Synthetic construct
  source 1..20: mol_type = other DNA
ggaagaggcctttagaaatg

SEQ ID NO: 1744 - DNA, 20 bp, Synthetic construct
  source 1..20: mol_type = other DNA
gtgtgagtaagaagggaccg

SEQ ID NO: 1745 - DNA, 20 bp, Synthetic construct
  source 1..20: mol_type = other DNA
agttttacaattgtaaaata

SEQ ID NO: 1746 - DNA, 20 bp, Synthetic construct
  source 1..20: mol_type = other DNA
atctctgggcacagatccca

SEQ ID NO: 1747 - DNA, 20 bp, Synthetic construct
  source 1..20: mol_type = other DNA
agatatcttgtgaccttgtg

SEQ ID NO: 1748 - DNA, 20 bp, Synthetic construct
  source 1..20: mol_type = other DNA
aggctcactccctgtcaagc

SEQ ID NO: 1749 - DNA, 20 bp, Synthetic construct
  source 1..20: mol_type = other DNA
acaagctctgccagtttaat

SEQ ID NO: 1750 - DNA, 20 bp, Synthetic construct
  source 1..20: mol_type = other DNA
actgagctgagcgatggagc

SEQ ID NO: 1751 - DNA, 20 bp, Synthetic construct
  source 1..20: mol_type = other DNA
agctgcggtcctgagggaag

SEQ ID NO: 1752 - DNA, 20 bp, Synthetic construct
  source 1..20: mol_type = other DNA
ttaacattaagagcagggaa

SEQ ID NO: 1753 - DNA, 20 bp, Synthetic construct
  source 1..20: mol_type = other DNA
ggtatgataggctctggcta

SEQ ID NO: 1754 - DNA, 20 bp, Synthetic construct
  source 1..20: mol_type = other DNA
agacagggcagatgtcaagc

SEQ ID NO: 1755 - DNA, 20 bp, Synthetic construct
  source 1..20: mol_type = other DNA
tctgctcacaaggcccccct

SEQ ID NO: 1756 - DNA, 20 bp, Synthetic construct
  source 1..20: mol_type = other DNA
gggaggttcggcccctccct

SEQ ID NO: 1757 - DNA, 20 bp, Synthetic construct
  source 1..20: mol_type = other DNA
agccatgaatgaaacacagg

SEQ ID NO: 1758 - DNA, 20 bp, Synthetic construct
  source 1..20: mol_type = other DNA
tgcgcccagacctgcctgct

SEQ ID NO: 1759 - DNA, 20 bp, Synthetic construct
  source 1..20: mol_type = other DNA
aaatgaattttattatgacc

SEQ ID NO: 1760 - DNA, 20 bp, Synthetic construct
  source 1..20: mol_type = other DNA
caagcatacactcactgttg

SEQ ID NO: 1761 - DNA, 20 bp, Synthetic construct
  source 1..20: mol_type = other DNA
aggcagctgtcacagagacc

SEQ ID NO: 1762 - DNA, 20 bp, Synthetic construct
  source 1..20: mol_type = other DNA
cattcctcagccttgcctta

SEQ ID NO: 1763 - DNA, 20 bp, Synthetic construct
  source 1..20: mol_type = other DNA
tccctctctcagttgcaatc

SEQ ID NO: 1764 - DNA, 20 bp, Synthetic construct
  source 1..20: mol_type = other DNA
tctttctgtttgtctttcat

SEQ ID NO: 1765 - DNA, 20 bp, Synthetic construct
  source 1..20: mol_type = other DNA
gtgtcctcttctgcctgccc

SEQ ID NO: 1766 - DNA, 20 bp, Synthetic construct
  source 1..20: mol_type = other DNA
tctcttgtacagagcaagaa

SEQ ID NO: 1767 - DNA, 20 bp, Synthetic construct
  source 1..20: mol_type = other DNA
agccatctcacttctctggt

SEQ ID NO: 1768 - DNA, 20 bp, Synthetic construct
  source 1..20: mol_type = other DNA
actactaataatagcaatag

SEQ ID NO: 1769 - DNA, 20 bp, Synthetic construct
  source 1..20: mol_type = other DNA
gtaatccatgaaaagcacag

SEQ ID NO: 1770 - DNA, 20 bp, Synthetic construct
  source 1..20: mol_type = other DNA
cttcggctctctcatctgtc

SEQ ID NO: 1771 - DNA, 20 bp, Synthetic construct
  source 1..20: mol_type = other DNA
caggtcagacacctctctgt

SEQ ID NO: 1772 - DNA, 20 bp, Synthetic construct
  source 1..20: mol_type = other DNA
gctctgagctgtggtgttct

SEQ ID NO: 1773 - DNA, 20 bp, Synthetic construct
  source 1..20: mol_type = other DNA
ccaaatgccccctctacagt

SEQ ID NO: 1774 - DNA, 20 bp, Synthetic construct
  source 1..20: mol_type = other DNA
cctctctgtgcttttctgcc

SEQ ID NO: 1775 - DNA, 20 bp, Synthetic construct
  source 1..20: mol_type = other DNA
ggtcctcccagccccatcgg

SEQ ID NO: 1776 - DNA, 20 bp, Synthetic construct
  source 1..20: mol_type = other DNA
cttaggcgagcggaggcctg

SEQ ID NO: 1777 - DNA, 20 bp, Synthetic construct
  source 1..20: mol_type = other DNA
gccagacctcagcacctagc

SEQ ID NO: 1778 - DNA, 20 bp, Synthetic construct
  source 1..20: mol_type = other DNA
gctcaccgtgccgcgcagag

SEQ ID NO: 1779 - DNA, 20 bp, Synthetic construct
  source 1..20: mol_type = other DNA
tcaggccccgccctcgaccc

SEQ ID NO: 1780 - DNA, 20 bp, Synthetic construct
  source 1..20: mol_type = other DNA
agatgagctctaccgtgagg

SEQ ID NO: 1781 - DNA, 20 bp, Synthetic construct
  source 1..20: mol_type = other DNA
atccattcagtcatcaaaca

SEQ ID NO: 1782 - DNA, 20 bp, Synthetic construct
  source 1..20: mol_type = other DNA
gtgaggagtccaatcttggc

SEQ ID NO: 1783 - DNA, 20 bp, Synthetic construct
  source 1..20: mol_type = other DNA
ggtgaagaaagttccaagga

SEQ ID NO: 1784 - DNA, 20 bp, Synthetic construct
  source 1..20: mol_type = other DNA
ttttccttgccaggaaagtc

SEQ ID NO: 1785 - DNA, 20 bp, Synthetic construct
  source 1..20: mol_type = other DNA
cccccgccccgcccgagaga

SEQ ID NO: 1786 - DNA, 20 bp, Synthetic construct
  source 1..20: mol_type = other DNA
ctaagaatcatttcagggcc

SEQ ID NO: 1787 - DNA, 20 bp, Synthetic construct
  source 1..20: mol_type = other DNA
taaatattctagtccagaag

SEQ ID NO: 1788 - DNA, 20 bp, Synthetic construct
  source 1..20: mol_type = other DNA
ggttagcctttctgatgctg

SEQ ID NO: 1789 - DNA, 20 bp, Synthetic construct
  source 1..20: mol_type = other DNA
gtattacctctactagtcag

SEQ ID NO: 1790 - DNA, 20 bp, Synthetic construct
  source 1..20: mol_type = other DNA
tgacctgtgactatctagga

SEQ ID NO: 1791 - DNA, 20 bp, Synthetic construct
  source 1..20: mol_type = other DNA
gccatttatctgtgctttag

SEQ ID NO: 1792 - DNA, 20 bp, Synthetic construct
  source 1..20: mol_type = other DNA
aaaggctgttaaacatgtgg

SEQ ID NO: 1793 - DNA, 20 bp, Synthetic construct
  source 1..20: mol_type = other DNA
gcctacttctctaggtggga

SEQ ID NO: 1794 - DNA, 20 bp, Synthetic construct
  source 1..20: mol_type = other DNA
acggtattgaaatcaggaga

SEQ ID NO: 1795 - DNA, 20 bp, Synthetic construct
  source 1..20: mol_type = other DNA
tggctgctctgtcttctggc

SEQ ID NO: 1796 - DNA, 20 bp, Synthetic construct
  source 1..20: mol_type = other DNA
ccctccccatcatgagtatg

SEQ ID NO: 1797 - DNA, 20 bp, Synthetic construct
  source 1..20: mol_type = other DNA
gaggaggcctctcatggact

SEQ ID NO: 1798 - DNA, 20 bp, Synthetic construct
  source 1..20: mol_type = other DNA
acggaattacattcagtttc

SEQ ID NO: 1799 - DNA, 20 bp, Synthetic construct
  source 1..20: mol_type = other DNA
attaggatcccatctagtgg

SEQ ID NO: 1800 - DNA, 20 bp, Synthetic construct
  source 1..20: mol_type = other DNA
aagctactaactttaattct

SEQ ID NO: 1801 - DNA, 20 bp, Synthetic construct
  source 1..20: mol_type = other DNA
gaaatggaaagccctcccca

SEQ ID NO: 1802 - DNA, 20 bp, Synthetic construct
  source 1..20: mol_type = other DNA
gtggtaagctgctggagtaa

SEQ ID NO: 1803 - DNA, 20 bp, Synthetic construct
  source 1..20: mol_type = other DNA
cgacttcccaggtcttactt

SEQ ID NO: 1804 - DNA, 20 bp, Synthetic construct
  source 1..20: mol_type = other DNA
gctctggctctgctcgctcc

SEQ ID NO: 1805 - DNA, 20 bp, Synthetic construct
  source 1..20: mol_type = other DNA
ggttcagctcagcagccagc

SEQ ID NO: 1806 - DNA, 20 bp, Synthetic construct
  source 1..20: mol_type = other DNA
tctataggcagccaggttgt

SEQ ID NO: 1807 - DNA, 20 bp, Synthetic construct
  source 1..20: mol_type = other DNA
ggatctctttcagggctgcg

SEQ ID NO: 1808 - DNA, 20 bp, Synthetic construct
  source 1..20: mol_type = other DNA
gaatggtgatccggttctcc

SEQ ID NO: 1809 - DNA, 20 bp, Synthetic construct
  source 1..20: mol_type = other DNA
tgcctcacatcacatccttg

SEQ ID NO: 1810 - DNA, 20 bp, Synthetic construct
  source 1..20: mol_type = other DNA
caggcctgatactgacggag

SEQ ID NO: 1811 - DNA, 20 bp, Synthetic construct
  source 1..20: mol_type = other DNA
agtaggtgccccccgccctc

SEQ ID NO: 1812 - DNA, 20 bp, Synthetic construct
  source 1..20: mol_type = other DNA
ttcccagatactccgagaga

SEQ ID NO: 1813 - DNA, 20 bp, Synthetic construct
  source 1..20: mol_type = other DNA
accaaaagacaaaacaagcc

SEQ ID NO: 1814 - DNA, 20 bp, Synthetic construct
  source 1..20: mol_type = other DNA
gcatagggatatcccacctc

SEQ ID NO: 1815 - DNA, 20 bp, Synthetic construct
  source 1..20: mol_type = other DNA
tgagtcatcgctcaggaggt

SEQ ID NO: 1816 - DNA, 20 bp, Synthetic construct
  source 1..20: mol_type = other DNA
tcctcctccatctctaccag

SEQ ID NO: 1817 - DNA, 20 bp, Synthetic construct
  source 1..20: mol_type = other DNA
caagaggatgagtcacttcc

SEQ ID NO: 1818 - DNA, 20 bp, Synthetic construct
  source 1..20: mol_type = other DNA
agtcatgccctgcccccatg

SEQ ID NO: 1819 - DNA, 20 bp, Synthetic construct
  source 1..20: mol_type = other DNA
agcaaggaagaggcctttag

SEQ ID NO: 1820 - DNA, 20 bp, Synthetic construct
  source 1..20: mol_type = other DNA
tgtgtgtgagtaagaaggga

SEQ ID NO: 1821 - DNA, 20 bp, Synthetic construct
  source 1..20: mol_type = other DNA
ctcagttttacaattgtaaa

SEQ ID NO: 1822 - DNA, 20 bp, Synthetic construct
  source 1..20: mol_type = other DNA
gggagaggagaaccctgaag

SEQ ID NO: 1823 - DNA, 20 bp, Synthetic construct
  source 1..20: mol_type = other DNA
ctggtgagcctgtattggta

SEQ ID NO: 1824 - DNA, 20 bp, Synthetic construct
  source 1..20: mol_type = other DNA
aaaatgacgcagtccaggcc

SEQ ID NO: 1825 - DNA, 20 bp, Synthetic construct
  source 1..20: mol_type = other DNA
taacaagctctgccagttta

SEQ ID NO: 1826 - DNA, 20 bp, Synthetic construct
  source 1..20: mol_type = other DNA
gaactgagtcagcactgagc

SEQ ID NO: 1827 - DNA, 20 bp, Synthetic construct
  source 1..20: mol_type = other DNA
tattcactgcaagagctgcg

SEQ ID NO: 1828 - DNA, 20 bp, Synthetic construct
  source 1..20: mol_type = other DNA
atatttaacattaagagcag

SEQ ID NO: 1829 - DNA, 20 bp, Synthetic construct
  source 1..20: mol_type = other DNA
cctggtatgataggctctgg

SEQ ID NO: 1830 - DNA, 20 bp, Synthetic construct
  source 1..20: mol_type = other DNA
atctgcagacagggcagatg

SEQ ID NO: 1831 - DNA, 20 bp, Synthetic construct
  source 1..20: mol_type = other DNA
agccccttctgctcacaagg

SEQ ID NO: 1832 - DNA, 20 bp, Synthetic construct
  source 1..20: mol_type = other DNA
cctggcagaaggcatgcggg

SEQ ID NO: 1833 - DNA, 20 bp, Synthetic construct
  source 1..20: mol_type = other DNA
caggctcagaataggtgagc

SEQ ID NO: 1834 - DNA, 20 bp, Synthetic construct
  source 1..20: mol_type = other DNA
cctgtgctttgcgcccagac

SEQ ID NO: 1835 - DNA, 20 bp, Synthetic construct
  source 1..20: mol_type = other DNA
ccaccttttgaaatgaattt

SEQ ID NO: 1836 - DNA, 20 bp, Synthetic construct
  source 1..20: mol_type = other DNA
atccacaagcatacactcac

SEQ ID NO: 1837 - DNA, 20 bp, Synthetic construct
  source 1..20: mol_type = other DNA
tgaatacctgcctcagtctc

SEQ ID NO: 1838 - DNA, 20 bp, Synthetic construct
  source 1..20: mol_type = other DNA
cccattcctcagccttgcct

SEQ ID NO: 1839 - DNA, 20 bp, Synthetic construct
  source 1..20: mol_type = other DNA
tgagtgtctctctcagtctc

SEQ ID NO: 1840 - DNA, 20 bp, Synthetic construct
  source 1..20: mol_type = other DNA
ccttagtgtctttctgtttg

SEQ ID NO: 1841 - DNA, 20 bp, Synthetic construct
  source 1..20: mol_type = other DNA
cgccattgtgtcctcttctg

SEQ ID NO: 1842 - DNA, 20 bp, Synthetic construct
  source 1..20: mol_type = other DNA
cattctcttgtacagagcaa

SEQ ID NO: 1843 - DNA, 20 bp, Synthetic construct
  source 1..20: mol_type = other DNA
cctgggcaagccatctcact

SEQ ID NO: 1844 - DNA, 20 bp, Synthetic construct
  source 1..20: mol_type = other DNA
aacagtatcagctactacta

SEQ ID NO: 1845 - DNA, 20 bp, Synthetic construct
  source 1..20: mol_type = other DNA
taaggtaatccatgaaaagc

SEQ ID NO: 1846 - DNA, 20 bp, Synthetic construct
  source 1..20: mol_type = other DNA
cccaagtgagatgtgctaga

SEQ ID NO: 1847 - DNA, 20 bp, Synthetic construct
  source 1..20: mol_type = other DNA
tccaggtcagacacctctct

SEQ ID NO: 1848 - DNA, 20 bp, Synthetic construct
  source 1..20: mol_type = other DNA
taagctctgagctgtggtgt

SEQ ID NO: 1849 - DNA, 20 bp, Synthetic construct
  source 1..20: mol_type = other DNA
gcccaaatgccccctctaca

SEQ ID NO: 1850 - DNA, 20 bp, Synthetic construct
  source 1..20: mol_type = other DNA
gccctgcctctctgtgcttt

SEQ ID NO: 1851 - DNA, 20 bp, Synthetic construct
  source 1..20: mol_type = other DNA
cagggaggtcctcccagccc

SEQ ID NO: 1852 - DNA, 20 bp, Synthetic construct
  source 1..20: mol_type = other DNA
ttccacactgacagctgcat

SEQ ID NO: 1853 - DNA, 20 bp, Synthetic construct
  source 1..20: mol_type = other DNA
tggctgggacttttcccaac

SEQ ID NO: 1854 - DNA, 20 bp, Synthetic construct
  source 1..20: mol_type = other DNA
cctgccctggccgcgctcac

SEQ ID NO: 1855 - DNA, 20 bp, Synthetic construct
  source 1..20: mol_type = other DNA
cgttcaggccccgccctcga

SEQ ID NO: 1856 - DNA, 20 bp, Synthetic construct
  source 1..20: mol_type = other DNA
aagggagcaagatgagctct

SEQ ID NO: 1857 - DNA, 20 bp, Synthetic construct
  source 1..20: mol_type = other DNA
ctaatcaatattggttgaat

SEQ ID NO: 1858 - DNA, 20 bp, Synthetic construct
  source 1..20: mol_type = other DNA
aggtgaggagtccaatcttg

SEQ ID NO: 1859 - DNA, 20 bp, Synthetic construct
  source 1..20: mol_type = other DNA
gaaagtggtgaagaaagttc

SEQ ID NO: 1860 - DNA, 20 bp, Synthetic construct
  source 1..20: mol_type = other DNA
ccatcatgacaacttgaacg

SEQ ID NO: 1861 - DNA, 20 bp, Synthetic construct
  source 1..20: mol_type = other DNA
aatttagctcccccctcccc

SEQ ID NO: 1862 - DNA, 20 bp, Synthetic construct
  source 1..20: mol_type = other DNA
ttagctaagaatcatttcag

SEQ ID NO: 1863 - DNA, 20 bp, Synthetic construct
  source 1..20: mol_type = other DNA
cctaaatattctagtccaga

SEQ ID NO: 1864 - DNA, 20 bp, Synthetic construct
  source 1..20: mol_type = other DNA
cctggttagcctttctgatg

SEQ ID NO: 1865 - DNA, 20 bp, Synthetic construct
  source 1..20: mol_type = other DNA
ttggcagtattacctctact

SEQ ID NO: 1866 - DNA, 20 bp, Synthetic construct
  source 1..20: mol_type = other DNA
tagtgacctgtgactatcta

SEQ ID NO: 1867 - DNA, 20 bp, Synthetic construct
  source 1..20: mol_type = other DNA
ctgccatttatctgtgcttt

SEQ ID NO: 1868 - DNA, 20 bp, Synthetic construct
  source 1..20: mol_type = other DNA
actaaaataaaggctgttaa

SEQ ID NO: 1869 - DNA, 20 bp, Synthetic construct
  source 1..20: mol_type = other DNA
aaccagccacatgactctgg

SEQ ID NO: 1870 - DNA, 20 bp, Synthetic construct
  source 1..20: mol_type = other DNA
gcacggtattgaaatcagga

SEQ ID NO: 1871 - DNA, 20 bp, Synthetic construct
  source 1..20: mol_type = other DNA
gctgctgccagagtcctggc

SEQ ID NO: 1872 - DNA, 20 bp, Synthetic construct
  source 1..20: mol_type = other DNA
ccccatcgcacccccctccc

SEQ ID NO: 1873 - DNA, 20 bp, Synthetic construct
  source 1..20: mol_type = other DNA
caggctggtttctgcagatg

SEQ ID NO: 1874 - DNA, 20 bp, Synthetic construct
  source 1..20: mol_type = other DNA
aaacggaattacattcagtt

SEQ ID NO: 1875 - DNA, 20 bp, Synthetic construct
  source 1..20: mol_type = other DNA
gtattaggatcccatctagt

SEQ ID NO: 1876 - DNA, 20 bp, Synthetic construct
  source 1..20: mol_type = other DNA
gaaagctactaactttaatt

SEQ ID NO: 1877 - DNA, 20 bp, Synthetic construct
  source 1..20: mol_type = other DNA
ccctggtagtttccttttac

SEQ ID NO: 1878 - DNA, 20 bp, Synthetic construct
  source 1..20: mol_type = other DNA
cgagtggtaagctgctggag

SEQ ID NO: 1879 - DNA, 20 bp, Synthetic construct
  source 1..20: mol_type = other DNA
ccttgggaagtccccgactt

SEQ ID NO: 1880 - DNA, 20 bp, Synthetic construct
  source 1..20: mol_type = other DNA
atcatctcccctgaggagac

SEQ ID NO: 1881 - DNA, 20 bp, Synthetic construct
  source 1..20: mol_type = other DNA
gtgggctccttggcccgcag

SEQ ID NO: 1882 - DNA, 20 bp, Synthetic construct
  source 1..20: mol_type = other DNA
ctgcttcctgtctataggca

SEQ ID NO: 1883 - DNA, 20 bp, Synthetic construct
  source 1..20: mol_type = other DNA
cggatctctttcagggctgc

SEQ ID NO: 1884 - DNA, 20 bp, Synthetic construct
  source 1..20: mol_type = other DNA
ggagaaggtctgcacgggaa

SEQ ID NO: 1885 - DNA, 20 bp, Synthetic construct
  source 1..20: mol_type = other DNA
ggtcctgcctcacatcacat

SEQ ID NO: 1886 - DNA, 20 bp, Synthetic construct
  source 1..20: mol_type = other DNA
ctggcaggcctgatactgac

SEQ ID NO: 1887 - DNA, 20 bp, Synthetic construct
  source 1..20: mol_type = other DNA
gggcgatgtagtaggtgccc

SEQ ID NO: 1888 - DNA, 20 bp, Synthetic construct
  source 1..20: mol_type = other DNA
tcaaaggcacagttcccaga

SEQ ID NO: 1889 - DNA, 20 bp, Synthetic construct
  source 1..20: mol_type = other DNA
aaccaaaagacaaaacaagc

SEQ ID NO: 1890 - DNA, 20 bp, Synthetic construct
  source 1..20: mol_type = other DNA
cagcatagggatatcccacc

SEQ ID NO: 1891 - DNA, 20 bp, Synthetic construct
  source 1..20: mol_type = other DNA
ttgagtcatcgctcaggagg

SEQ ID NO: 1892 - DNA, 20 bp, Synthetic construct
  source 1..20: mol_type = other DNA
ctcctcctccatctctacca

SEQ ID NO: 1893 - DNA, 20 bp, Synthetic construct
  source 1..20: mol_type = other DNA
atcttcaagaggatgagtca

SEQ ID NO: 1894 - DNA, 20 bp, Synthetic construct
  source 1..20: mol_type = other DNA
aaagtcatgccctgccccca

SEQ ID NO: 1895 - DNA, 20 bp, Synthetic construct
  source 1..20: mol_type = other DNA
ggtatgacacagcaaggaag

SEQ ID NO: 1896 - DNA, 20 bp, Synthetic construct
  source 1..20: mol_type = other DNA
ttgtgtgtgagtaagaaggg

SEQ ID NO: 1897 - DNA, 20 bp, Synthetic construct
  source 1..20: mol_type = other DNA
cgtgcctcagttttacaatt

SEQ ID NO: 1898 - DNA, 20 bp, Synthetic construct
  source 1..20: mol_type = other DNA
tggagggaaaggacaccaag

SEQ ID NO: 1899 - DNA, 20 bp, Synthetic construct
  source 1..20: mol_type = other DNA
tctttggtgcttttgccccc

SEQ ID NO: 1900 - DNA, 20 bp, Synthetic construct
  source 1..20: mol_type = other DNA
tctggtgagcctgtattggt

SEQ ID NO: 1901 - DNA, 20 bp, Synthetic construct
  source 1..20: mol_type = other DNA
gggaaaatgacgcagtccag

SEQ ID NO: 1902 - DNA, 20 bp, Synthetic construct
  source 1..20: mol_type = other DNA
gcgcacccaaggactcacca

SEQ ID NO: 1903 - DNA, 20 bp, Synthetic construct
  source 1..20: mol_type = other DNA
ctgaactgagtcagcactga

SEQ ID NO: 1904 - DNA, 20 bp, Synthetic construct
  source 1..20: mol_type = other DNA
aaactttattcactgcaaga

SEQ ID NO: 1905 - DNA, 20 bp, Synthetic construct
  source 1..20: mol_type = other DNA
gtaccctggtatgataggct

SEQ ID NO: 1906 - DNA, 20 bp, Synthetic construct
  source 1..20: mol_type = other DNA
acactcagaagggcagtgct

SEQ ID NO: 1907 - DNA, 20 bp, Synthetic construct
  source 1..20: mol_type = other DNA
cagccccttctgctcacaag

SEQ ID NO: 1908 - DNA, 20 bp, Synthetic construct
  source 1..20: mol_type = other DNA
ccctggactcctggcagaag

SEQ ID NO: 1909 - DNA, 20 bp, Synthetic construct
  source 1..20: mol_type = other DNA
catcaaccttctccgcttcc

SEQ ID NO: 1910 - DNA, 20 bp, Synthetic construct
  source 1..20: mol_type = other DNA
acctgtgctttgcgcccaga

SEQ ID NO: 1911 - DNA, 20 bp, Synthetic construct
  source 1..20: mol_type = other DNA
tgcatgtcctgtcagctcag

SEQ ID NO: 1912 - DNA, 20 bp, Synthetic construct
  source 1..20: mol_type = other DNA
gcgcatccacaagcatacac

SEQ ID NO: 1913 - DNA, 20 bp, Synthetic construct
  source 1..20: mol_type = other DNA
ttgaatacctgcctcagtct

SEQ ID NO: 1914 - DNA, 20 bp, Synthetic construct
  source 1..20: mol_type = other DNA
tgaggagtagagggccactg

SEQ ID NO: 1915 - DNA, 20 bp, Synthetic construct
  source 1..20: mol_type = other DNA
tctgagtgtctctctcagtc

SEQ ID NO: 1916 - DNA, 20 bp, Synthetic construct
  source 1..20: mol_type = other DNA
tcccttagtgtctttctgtt

SEQ ID NO: 1917 - DNA, 20 bp, Synthetic construct
  source 1..20: mol_type = other DNA
ccccacgccattgtgtcctc

SEQ ID NO: 1918 - DNA, 20 bp, Synthetic construct
  source 1..20: mol_type = other DNA
cccattctcttgtacagagc

SEQ ID NO: 1919 - DNA, 20 bp, Synthetic construct
  source 1..20: mol_type = other DNA
ccctgggcaagccatctcac

SEQ ID NO: 1920 - DNA, 20 bp, Synthetic construct
  source 1..20: mol_type = other DNA
aacagaacagtatcagctac

SEQ ID NO: 1921 - DNA, 20 bp, Synthetic construct
  source 1..20: mol_type = other DNA
gtaaggtaatccatgaaaag

SEQ ID NO: 1922 - DNA, 20 bp, Synthetic construct
  source 1..20: mol_type = other DNA
ggctcccaagtgagatgtgc

SEQ ID NO: 1923 - DNA, 20 bp, Synthetic construct
  source 1..20: mol_type = other DNA
cttccaggtcagacacctct

SEQ ID NO: 1924 - DNA, 20 bp, Synthetic construct
  source 1..20: mol_type = other DNA
ataagctctgagctgtggtg

SEQ ID NO: 1925 - DNA, 20 bp, Synthetic construct
  source 1..20: mol_type = other DNA
agcccaaatgccccctctac

SEQ ID NO: 1926 - DNA, 20 bp, Synthetic construct
  source 1..20: mol_type = other DNA
cagctaggtgccctggctag

SEQ ID NO: 1927 - DNA, 20 bp, Synthetic construct
  source 1..20: mol_type = other DNA
ccctgcctgcagggaggtcc

SEQ ID NO: 1928 - DNA, 20 bp, Synthetic construct
  source 1..20: mol_type = other DNA
cagtgccacagaatccagaa

SEQ ID NO: 1929 - DNA, 20 bp, Synthetic construct
  source 1..20: mol_type = other DNA
ccccagttaaccccaggacg

SEQ ID NO: 1930 - DNA, 20 bp, Synthetic construct
  source 1..20: mol_type = other DNA
tccccgtcctgccctggccg

SEQ ID NO: 1931 - DNA, 20 bp, Synthetic construct
  source 1..20: mol_type = other DNA
gccccaggccccgcctctag

SEQ ID NO: 1932 - DNA, 20 bp, Synthetic construct
  source 1..20: mol_type = other DNA
cagtccctgaagggagcaag

SEQ ID NO: 1933 - DNA, 20 bp, Synthetic construct
  source 1..20: mol_type = other DNA
gcctaatcaatattggttga

SEQ ID NO: 1934 - DNA, 20 bp, Synthetic construct
  source 1..20: mol_type = other DNA
tgaggtgaggagtccaatct

SEQ ID NO: 1935 - DNA, 20 bp, Synthetic construct
  source 1..20: mol_type = other DNA
ctgaaggaagatggaaaagg

SEQ ID NO: 1936 - DNA, 20 bp, Synthetic construct
  source 1..20: mol_type = other DNA
ggccatcatgacaacttgaa

SEQ ID NO: 1937 - DNA, 20 bp, Synthetic construct
  source 1..20: mol_type = other DNA
taatttagctcccccctccc

SEQ ID NO: 1938 - DNA, 20 bp, Synthetic construct
  source 1..20: mol_type = other DNA
cttagctaagaatcatttca

SEQ ID NO: 1939 - DNA, 20 bp, Synthetic construct
  source 1..20: mol_type = other DNA
tcctaaatattctagtccag

SEQ ID NO: 1940 - DNA, 20 bp, Synthetic construct
  source 1..20: mol_type = other DNA
agcctggttagcctttctga

SEQ ID NO: 1941 - DNA, 20 bp, Synthetic construct
  source 1..20: mol_type = other DNA
tttggcagtattacctctac

SEQ ID NO: 1942 - DNA, 20 bp, Synthetic construct
  source 1..20: mol_type = other DNA
ttagtgacctgtgactatct

SEQ ID NO: 1943 - DNA, 20 bp, Synthetic construct
  source 1..20: mol_type = other DNA
ctctgccatttatctgtgct

SEQ ID NO: 1944 - DNA, 20 bp, Synthetic construct
  source 1..20: mol_type = other DNA
ttaactaaaataaaggctgt

SEQ ID NO: 1945 - DNA, 20 bp, Synthetic construct
  source 1..20: mol_type = other DNA
tcaagaagtcccaacttagc

SEQ ID NO: 1946 - DNA, 20 bp, Synthetic construct
  source 1..20: mol_type = other DNA
agcacggtattgaaatcagg

SEQ ID NO: 1947 - DNA, 20 bp, Synthetic construct
  source 1..20: mol_type = other DNA
tgctgctgccagagtcctgg

SEQ ID NO: 1948 - DNA, 20 bp, Synthetic construct
  source 1..20: mol_type = other DNA
catgcccggcttccccatcg

SEQ ID NO: 1949 - DNA, 20 bp, Synthetic construct
  source 1..20: mol_type = other DNA
cttacctctccatcccgcat

SEQ ID NO: 1950 - DNA, 20 bp, Synthetic construct
  source 1..20: mol_type = other DNA
gaggaaacggaattacattc

SEQ ID NO: 1951 - DNA, 20 bp, Synthetic construct
  source 1..20: mol_type = other DNA
tgtattaggatcccatctag

SEQ ID NO: 1952 - DNA, 20 bp, Synthetic construct
  source 1..20: mol_type = other DNA
tgaaagctactaactttaat

SEQ ID NO: 1953 - DNA, 20 bp, Synthetic construct
  source 1..20: mol_type = other DNA
attcccctggtagtttcctt

SEQ ID NO: 1954 - DNA, 20 bp, Synthetic construct
  source 1..20: mol_type = other DNA
gcgagtggtaagctgctgga

SEQ ID NO: 1955 - DNA, 20 bp, Synthetic construct
  source 1..20: mol_type = other DNA
aggctgtgtaaccttgggaa

SEQ ID NO: 1956 - DNA, 20 bp, Synthetic construct
  source 1..20: mol_type = other DNA
catcatctcccctgaggaga

SEQ ID NO: 1957 - DNA, 20 bp, Synthetic construct
  source 1..20: mol_type = other DNA
cttggtgggctccttggccc

SEQ ID NO: 1958 - DNA, 20 bp, Synthetic construct
  source 1..20: mol_type = other DNA
tctgcttcctgtctataggc

SEQ ID NO: 1959 - DNA, 20 bp, Synthetic construct
  source 1..20: mol_type = other DNA
gcggatctctttcagggctg

SEQ ID NO: 1960 - DNA, 20 bp, Synthetic construct
  source 1..20: mol_type = other DNA
ttctcgaatctgcaggttgg

SEQ ID NO: 1961 - DNA, 20 bp, Synthetic construct
  source 1..20: mol_type = other DNA
caggtgggtcctgcctcaca

SEQ ID NO: 1962 - DNA, 20 bp, Synthetic construct
  source 1..20: mol_type = other DNA
tctggcaggcctgatactga

SEQ ID NO: 1963 - DNA, 20 bp, Synthetic construct
  source 1..20: mol_type = other DNA
gagggcgatgtagtaggtgc

SEQ ID NO: 1964 - DNA, 20 bp, Synthetic construct
  source 1..20: mol_type = other DNA
ggaaactcaaaggcacagtt

SEQ ID NO: 1965 - DNA, 20 bp, Synthetic construct
  source 1..20: mol_type = other DNA
ctcataaaaaccaaaagaca

SEQ ID NO: 1966 - DNA, 20 bp, Synthetic construct
  source 1..20: mol_type = other DNA
gcagcatagggatatcccac

SEQ ID NO: 1967 - DNA, 20 bp, Synthetic construct
  source 1..20: mol_type = other DNA
ctgagacacttgagtcatcg

SEQ ID NO: 1968 - DNA, 20 bp, Synthetic construct
  source 1..20: mol_type = other DNA
gcctcctcctccatctctac

SEQ ID NO: 1969 - DNA, 20 bp, Synthetic construct
  source 1..20: mol_type = other DNA
cagcatcttcaagaggatga

SEQ ID NO: 1970 - DNA, 20 bp, Synthetic construct
  source 1..20: mol_type = other DNA
caaagtcatgccctgccccc

SEQ ID NO: 1971 - DNA, 20 bp, Synthetic construct
  source 1..20: mol_type = other DNA
tggtatgacacagcaaggaa

SEQ ID NO: 1972 - DNA, 20 bp, Synthetic construct
  source 1..20: mol_type = other DNA
ttttgtgtgtgagtaagaag

SEQ ID NO: 1973 - DNA, 20 bp, Synthetic construct
  source 1..20: mol_type = other DNA
gccagtgtcttcactttgct

SEQ ID NO: 1974 - DNA, 20 bp, Synthetic construct
  source 1..20: mol_type = other DNA
cagtgccctgaagattagca

SEQ ID NO: 1975 - DNA, 20 bp, Synthetic construct
  source 1..20: mol_type = other DNA
gtctttggtgcttttgcccc

SEQ ID NO: 1976 - DNA, 20 bp, Synthetic construct
  source 1..20: mol_type = other DNA
atctggtgagcctgtattgg

SEQ ID NO: 1977 - DNA, 20 bp, Synthetic construct
  source 1..20: mol_type = other DNA
tgggaaaatgacgcagtcca

SEQ ID NO: 1978 - DNA, 20 bp, Synthetic construct
  source 1..20: mol_type = other DNA
cagagcagctccactgcgca

SEQ ID NO: 1979 - DNA, 20 bp, Synthetic construct
  source 1..20: mol_type = other DNA
tctgaactgagtcagcactg

SEQ ID NO: 1980 - DNA, 20 bp, Synthetic construct
  source 1..20: mol_type = other DNA
aaaactttattcactgcaag

SEQ ID NO: 1981 - DNA, 20 bp, Synthetic construct
  source 1..20: mol_type = other DNA
acctcgaatctgcaggttgg

SEQ ID NO: 1982 - DNA, 20 bp, Synthetic construct
  source 1..20: mol_type = other DNA
agtaccctggtatgataggc

SEQ ID NO: 1983 - DNA, 20 bp, Synthetic construct
  source 1..20: mol_type = other DNA
gacaagcagttaaaaaaaca

SEQ ID NO: 1984 - DNA, 20 bp, Synthetic construct
  source 1..20: mol_type = other DNA
tcagccccttctgctcacaa

SEQ ID NO: 1985 - DNA, 20 bp, Synthetic construct
  source 1..20: mol_type = other DNA
ctttccccagtagggaggtg

SEQ ID NO: 1986 - DNA, 20 bp, Synthetic construct
  source 1..20: mol_type = other DNA
tcatggacatcaaccttctc

SEQ ID NO: 1987 - DNA, 20 bp, Synthetic construct
  source 1..20: mol_type = other DNA
gtcacctgtgctttgcgccc

SEQ ID NO: 1988 - DNA, 20 bp, Synthetic construct
  source 1..20: mol_type = other DNA
catgcatgtcctgtcagctc

SEQ ID NO: 1989 - DNA, 20 bp, Synthetic construct
  source 1..20: mol_type = other DNA
ggcgcatccacaagcataca

SEQ ID NO: 1990 - DNA, 20 bp, Synthetic construct
  source 1..20: mol_type = other DNA
tgaggacacttgaatacctg

SEQ ID NO: 1991 - DNA, 20 bp, Synthetic construct
  source 1..20: mol_type = other DNA
gcttcctggagtggcaggag

SEQ ID NO: 1992 - DNA, 20 bp, Synthetic construct
  source 1..20: mol_type = other DNA
tctcctctctctgagtgtct

SEQ ID NO: 1993 - DNA, 20 bp, Synthetic construct
  source 1..20: mol_type = other DNA
tctcccttagtgtctttctg

SEQ ID NO: 1994 - DNA, 20 bp, Synthetic construct
  source 1..20: mol_type = other DNA
gggttccccacgccattgtg

SEQ ID NO: 1995 - DNA, 20 bp, Synthetic construct
  source 1..20: mol_type = other DNA
cccccattctcttgtacaga

SEQ ID NO: 1996 - DNA, 20 bp, Synthetic construct
  source 1..20: mol_type = other DNA
agcaatagtgcctgtgtgac

SEQ ID NO: 1997 - DNA, 20 bp, Synthetic construct
  source 1..20: mol_type = other DNA
gaacagaacagtatcagcta

SEQ ID NO: 1998 - DNA, 20 bp, Synthetic construct
  source 1..20: mol_type = other DNA
agtaaggtaatccatgaaaa

SEQ ID NO: 1999 - DNA, 20 bp, Synthetic construct
  source 1..20: mol_type = other DNA
aggctcccaagtgagatgtg

SEQ ID NO: 2000 - DNA, 20 bp, Synthetic construct
  source 1..20: mol_type = other DNA
atcacaccttccaggtcaga

SEQ ID NO: 2001 - DNA, 20 bp, Synthetic construct
  source 1..20: mol_type = other DNA
atataagctctgagctgtgg

SEQ ID NO: 2002 - DNA, 20 bp, Synthetic construct
  source 1..20: mol_type = other DNA
tagcccaaatgccccctcta

SEQ ID NO: 2003 - DNA, 20 bp, Synthetic construct
  source 1..20: mol_type = other DNA
ctcctcagctaggtgccctg

SEQ ID NO: 2004 - DNA, 20 bp, Synthetic construct
  source 1..20: mol_type = other DNA
ctcccctgcctgcagggagg

SEQ ID NO: 2005 - DNA, 20 bp, Synthetic construct
  source 1..20: mol_type = other DNA
atgaacagtgccacagaatc

SEQ ID NO: 2006 - DNA, 20 bp, Synthetic construct
  source 1..20: mol_type = other DNA
accccagttaaccccaggac

SEQ ID NO: 2007 - DNA, 20 bp, Synthetic construct
  source 1..20: mol_type = other DNA
cgtccccgtcctgccctggc

SEQ ID NO: 2008 - DNA, 20 bp, Synthetic construct
  source 1..20: mol_type = other DNA
tttcgaggcccggcccccgg

SEQ ID NO: 2009 - DNA, 20 bp, Synthetic construct
  source 1..20: mol_type = other DNA
agactcagtccctgaaggga

SEQ ID NO: 2010 - DNA, 20 bp, Synthetic construct
  source 1..20: mol_type = other DNA
ggcctaatcaatattggttg

SEQ ID NO: 2011 - DNA, 20 bp, Synthetic construct
  source 1..20: mol_type = other DNA
ggtgaggtgaggagtccaat

SEQ ID NO: 2012 - DNA, 20 bp, Synthetic construct
  source 1..20: mol_type = other DNA
catgtctatctgaaggaaga

SEQ ID NO: 2013 - DNA, 20 bp, Synthetic construct
  source 1..20: mol_type = other DNA
ggacacccctaggctgggtc

SEQ ID NO: 2014 - DNA, 20 bp, Synthetic construct
  source 1..20: mol_type = other DNA
aaaaagtaatttagctcccc

SEQ ID NO: 2015 - DNA, 20 bp, Synthetic construct
  source 1..20: mol_type = other DNA
ccttagctaagaatcatttc

SEQ ID NO: 2016 - DNA, 20 bp, Synthetic construct
  source 1..20: mol_type = other DNA
gtcctaaatattctagtcca

SEQ ID NO: 2017 - DNA, 20 bp, Synthetic construct
  source 1..20: mol_type = other DNA
cagcctggttagcctttctg

SEQ ID NO: 2018 - DNA, 20 bp, Synthetic construct
  source 1..20: mol_type = other DNA
atttggcagtattacctcta

SEQ ID NO: 2019 - DNA, 20 bp, Synthetic construct
  source 1..20: mol_type = other DNA
tttagtgacctgtgactatc

SEQ ID NO: 2020 - DNA, 20 bp, Synthetic construct
  source 1..20: mol_type = other DNA
tctctgccatttatctgtgc

SEQ ID NO: 2021 - DNA, 20 bp, Synthetic construct
  source 1..20: mol_type = other DNA
attaactaaaataaaggctg

SEQ ID NO: 2022 - DNA, 20 bp, Synthetic construct
  source 1..20: mol_type = other DNA
ctcaagaagtcccaacttag

SEQ ID NO: 2023 - DNA, 20 bp, Synthetic construct
  source 1..20: mol_type = other DNA
ccagcacggtattgaaatca

SEQ ID NO: 2024 - DNA, 20 bp, Synthetic construct
  source 1..20: mol_type = other DNA
tagtgctgctgccagagtcc

SEQ ID NO: 2025 - DNA, 20 bp, Synthetic construct
  source 1..20: mol_type = other DNA
ctcccatgcccggcttcccc

SEQ ID NO: 2026 - DNA, 20 bp, Synthetic construct
  source 1..20: mol_type = other DNA
tggcctggccttgagaatcc

SEQ ID NO: 2027 - DNA, 20 bp, Synthetic construct
  source 1..20: mol_type = other DNA
tatggagggactgaggaaac

SEQ ID NO: 2028 - DNA, 20 bp, Synthetic construct
  source 1..20: mol_type = other DNA
gtgtattaggatcccatcta

SEQ ID NO: 2029 - DNA, 20 bp, Synthetic construct
  source 1..20: mol_type = other DNA
gtgaaagctactaactttaa

SEQ ID NO: 2030 - DNA, 20 bp, Synthetic construct
  source 1..20: mol_type = other DNA
atcccctcttcccattcccc

SEQ ID NO: 2031 - DNA, 20 bp, Synthetic construct
  source 1..20: mol_type = other DNA
ggcgagtggtaagctgctgg

SEQ ID NO: 2032 - DNA, 20 bp, Synthetic construct
  source 1..20: mol_type = other DNA
cgaggctgtgtaaccttggg

SEQ ID NO: 2033 - DNA, 20 bp, Synthetic construct
  source 1..20: mol_type = other DNA
cccagacggcggccaggagc

SEQ ID NO: 2034 - DNA, 20 bp, Synthetic construct
  source 1..20: mol_type = other DNA
gcagctcagcctggtagacg

SEQ ID NO: 2035 - DNA, 20 bp, Synthetic construct
  source 1..20: mol_type = other DNA
cttcatctgcttcctgtcta

SEQ ID NO: 2036 - DNA, 20 bp, Synthetic construct
  source 1..20: mol_type = other DNA
aacttggagcggtaccactc

SEQ ID NO: 2037 - DNA, 20 bp, Synthetic construct
  source 1..20: mol_type = other DNA
tctgacacagacttggtgtc

SEQ ID NO: 2038 - DNA, 20 bp, Synthetic construct
  source 1..20: mol_type = other DNA
ctgctcgggcccctcatgag

SEQ ID NO: 2039 - DNA, 20 bp, Synthetic construct
  source 1..20: mol_type = other DNA
gtctggcaggcctgatactg

SEQ ID NO: 2040 - DNA, 20 bp, Synthetic construct
  source 1..20: mol_type = other DNA
ggagggcgatgtagtaggtg

SEQ ID NO: 2041 - DNA, 20 bp, Synthetic construct
  source 1..20: mol_type = other DNA
ctgagtctcagttttcctcc

SEQ ID NO: 2042 - DNA, 20 bp, Synthetic construct
  source 1..20: mol_type = other DNA
cctcataaaaaccaaaagac

SEQ ID NO: 2043 - DNA, 20 bp, Synthetic construct
  source 1..20: mol_type = other DNA
ggcagcatagggatatccca

SEQ ID NO: 2044 - DNA, 20 bp, Synthetic construct
  source 1..20: mol_type = other DNA
actgagacacttgagtcatc

SEQ ID NO: 2045 - DNA, 20 bp, Synthetic construct
  source 1..20: mol_type = other DNA
caattgcctcctcctccatc

SEQ ID NO: 2046 - DNA, 20 bp, Synthetic construct
  source 1..20: mol_type = other DNA
gtttcagcatcttcaagagg

SEQ ID NO: 2047 - DNA, 20 bp, Synthetic construct
  source 1..20: mol_type = other DNA
acaaagtcatgccctgcccc

SEQ ID NO: 2048 - DNA, 20 bp, Synthetic construct
  source 1..20: mol_type = other DNA
ctggtatgacacagcaagga

SEQ ID NO: 2049 - DNA, 20 bp, Synthetic construct
  source 1..20: mol_type = other DNA
attttgtgtgtgagtaagaa

SEQ ID NO: 2050 - DNA, 20 bp, Synthetic construct
  source 1..20: mol_type = other DNA
gagccagtgtcttcactttg

SEQ ID NO: 2051 - DNA, 20 bp, Synthetic construct
  source 1..20: mol_type = other DNA
gcagtgccctgaagattagc

SEQ ID NO: 2052 - DNA, 20 bp, Synthetic construct
  source 1..20: mol_type = other DNA
tccccgtctttggtgctttt

SEQ ID NO: 2053 - DNA, 20 bp, Synthetic construct
  source 1..20: mol_type = other DNA
catttacaatctggtgagcc

SEQ ID NO: 2054 - DNA, 20 bp, Synthetic construct
  source 1..20: mol_type = other DNA
cctgggaaaatgacgcagtc

SEQ ID NO: 2055 - DNA, 20 bp, Synthetic construct
  source 1..20: mol_type = other DNA
gctcagaggccccagagcag

SEQ ID NO: 2056 - DNA, 20 bp, Synthetic construct
  source 1..20: mol_type = other DNA
ctctgaactgagtcagcact

SEQ ID NO: 2057 - DNA, 20 bp, Synthetic construct
  source 1..20: mol_type = other DNA
ataaaactttattcactgca

SEQ ID NO: 2058 - DNA, 20 bp, Synthetic construct
  source 1..20: mol_type = other DNA
gcccttcccacgaggccctg

SEQ ID NO: 2059 - DNA, 20 bp, Synthetic construct
  source 1..20: mol_type = other DNA
gaagtaccctggtatgatag

SEQ ID NO: 2060 - DNA, 20 bp, Synthetic construct
  source 1..20: mol_type = other DNA
tgacaagcagttaaaaaaac

SEQ ID NO: 2061 - DNA, 20 bp, Synthetic construct
  source 1..20: mol_type = other DNA
ttcagccccttctgctcaca

SEQ ID NO: 2062 - DNA, 20 bp, Synthetic construct
  source 1..20: mol_type = other DNA
tgctttccccagtagggagg

SEQ ID NO: 2063 - DNA, 20 bp, Synthetic construct
  source 1..20: mol_type = other DNA
aatctccctcatggacatca

SEQ ID NO: 2064 - DNA, 20 bp, Synthetic construct
  source 1..20: mol_type = other DNA
gcaggcagtcacctgtgctt

SEQ ID NO: 2065 - DNA, 20 bp, Synthetic construct
  source 1..20: mol_type = other DNA
aaggcacacatgcatgtcct

SEQ ID NO: 2066 - DNA, 20 bp, Synthetic construct
  source 1..20: mol_type = other DNA
ctgcttctgctcacacaggc

SEQ ID NO: 2067 - DNA, 20 bp, Synthetic construct
  source 1..20: mol_type = other DNA
ctgaggacacttgaatacct

SEQ ID NO: 2068 - DNA, 20 bp, Synthetic construct
  source 1..20: mol_type = other DNA
ctgcttcctggagtggcagg

SEQ ID NO: 2069 - DNA, 20 bp, Synthetic construct
  source 1..20: mol_type = other DNA
ctctcctctctctgagtgtc

SEQ ID NO: 2070 - DNA, 20 bp, Synthetic construct
  source 1..20: mol_type = other DNA
tctttccgtctcccttagtg

SEQ ID NO: 2071 - DNA, 20 bp, Synthetic construct
  source 1..20: mol_type = other DNA
agggtacaggccacagctgg

SEQ ID NO: 2072 - DNA, 20 bp, Synthetic construct
  source 1..20: mol_type = other DNA
cttcccccattctcttgtac

SEQ ID NO: 2073 - DNA, 20 bp, Synthetic construct
  source 1..20: mol_type = other DNA
aaagcaatagtgcctgtgtg

SEQ ID NO: 2074 - DNA, 20 bp, Synthetic construct
  source 1..20: mol_type = other DNA
agaacagaacagtatcagct

SEQ ID NO: 2075 - DNA, 20 bp, Synthetic construct
  source 1..20: mol_type = other DNA
tagtaaggtaatccatgaaa

SEQ ID NO: 2076 - DNA, 20 bp, Synthetic construct
  source 1..20: mol_type = other DNA
aggcatggaatgcaggctcc

SEQ ID NO: 2077 - DNA, 20 bp, Synthetic construct
  source 1..20: mol_type = other DNA
tatcacaccttccaggtcag

SEQ ID NO: 2078 - DNA, 20 bp, Synthetic construct
  source 1..20: mol_type = other DNA
catataagctctgagctgtg

SEQ ID NO: 2079 - DNA, 20 bp, Synthetic construct
  source 1..20: mol_type = other DNA
ctagcccaaatgccccctct

SEQ ID NO: 2080 - DNA, 20 bp, Synthetic construct
  source 1..20: mol_type = other DNA
cactcctcagctaggtgccc

SEQ ID NO: 2081 - DNA, 20 bp, Synthetic construct
  source 1..20: mol_type = other DNA
tctcccctgcctgcagggag

SEQ ID NO: 2082 - DNA, 20 bp, Synthetic construct
  source 1..20: mol_type = other DNA
gaatgaacagtgccacagaa

SEQ ID NO: 2083 - DNA, 20 bp, Synthetic construct
  source 1..20: mol_type = other DNA
caccccagttaaccccagga

SEQ ID NO: 2084 - DNA, 20 bp, Synthetic construct
  source 1..20: mol_type = other DNA
ccgtccccgtcctgccctgg

SEQ ID NO: 2085 - DNA, 20 bp, Synthetic construct
  source 1..20: mol_type = other DNA
gtttcgaggcccggcccccg

SEQ ID NO: 2086 - DNA, 20 bp, Synthetic construct
  source 1..20: mol_type = other DNA
aaagactcagtccctgaagg

SEQ ID NO: 2087 - DNA, 20 bp, Synthetic construct
  source 1..20: mol_type = other DNA
aggcctaatcaatattggtt

SEQ ID NO: 2088 - DNA, 20 bp, Synthetic construct
  source 1..20: mol_type = other DNA
gggtgaggtgaggagtccaa

SEQ ID NO: 2089 - DNA, 20 bp, Synthetic construct
  source 1..20: mol_type = other DNA
gcatgtctatctgaaggaag

SEQ ID NO: 2090 - DNA, 20 bp, Synthetic construct
  source 1..20: mol_type = other DNA
tgcctgggacacccctaggc

SEQ ID NO: 2091 - DNA, 20 bp, Synthetic construct
  source 1..20: mol_type = other DNA
taaaaagtaatttagctccc

SEQ ID NO: 2092 - DNA, 20 bp, Synthetic construct
  source 1..20: mol_type = other DNA
attttgttccttagctaaga

SEQ ID NO: 2093 - DNA, 20 bp, Synthetic construct
  source 1..20: mol_type = other DNA
ggtcctaaatattctagtcc

SEQ ID NO: 2094 - DNA, 20 bp, Synthetic construct
  source 1..20: mol_type = other DNA
tcagcctggttagcctttct

SEQ ID NO: 2095 - DNA, 20 bp, Synthetic construct
  source 1..20: mol_type = other DNA
gatttggcagtattacctct

SEQ ID NO: 2096 - DNA, 20 bp, Synthetic construct
  source 1..20: mol_type = other DNA
ctttagtgacctgtgactat

SEQ ID NO: 2097 - DNA, 20 bp, Synthetic construct
  source 1..20: mol_type = other DNA
acttctctctgccatttatc

SEQ ID NO: 2098 - DNA, 20 bp, Synthetic construct
  source 1..20: mol_type = other DNA
aattaactaaaataaaggct

SEQ ID NO: 2099 - DNA, 20 bp, Synthetic construct
  source 1..20: mol_type = other DNA
agaccagagctcaagaagtc

SEQ ID NO: 2100 - DNA, 20 bp, Synthetic construct
  source 1..20: mol_type = other DNA
cccagcacggtattgaaatc

SEQ ID NO: 2101 - DNA, 20 bp, Synthetic construct
  source 1..20: mol_type = other DNA
atagtgctgctgccagagtc

SEQ ID NO: 2102 - DNA, 20 bp, Synthetic construct
  source 1..20: mol_type = other DNA
ctctcccatgcccggcttcc

SEQ ID NO: 2103 - DNA, 20 bp, Synthetic construct
  source 1..20: mol_type = other DNA
catggcctggccttgagaat

SEQ ID NO: 2104 - DNA, 20 bp, Synthetic construct
  source 1..20: mol_type = other DNA
ccccttagaacagcctatgg

SEQ ID NO: 2105 - DNA, 20 bp, Synthetic construct
  source 1..20: mol_type = other DNA
tgtgtattaggatcccatct

SEQ ID NO: 2106 - DNA, 20 bp, Synthetic construct
  source 1..20: mol_type = other DNA
agtgaaagctactaacttta

SEQ ID NO: 2107 - DNA, 20 bp, Synthetic construct
  source 1..20: mol_type = other DNA
aatcccctcttcccattccc

SEQ ID NO: 2108 - DNA, 20 bp, Synthetic construct
  source 1..20: mol_type = other DNA
ctggcgagtggtaagctgct

SEQ ID NO: 2109 - DNA, 20 bp, Synthetic construct
  source 1..20: mol_type = other DNA
tccaccaccacgaggctgtg

SEQ ID NO: 2110 - DNA, 20 bp, Synthetic construct
  source 1..20: mol_type = other DNA
gaggcgggtgccaggaccca

SEQ ID NO: 2111 - DNA, 20 bp, Synthetic construct
  source 1..20: mol_type = other DNA
cgcagctcagcctggtagac

SEQ ID NO: 2112 - DNA, 20 bp, Synthetic construct
  source 1..20: mol_type = other DNA
tctcctcctccagcgactca

SEQ ID NO: 2113 - DNA, 20 bp, Synthetic construct
  source 1..20: mol_type = other DNA
ctgtcaggtctgcaaacttg

SEQ ID NO: 2114 - DNA, 20 bp, Synthetic construct
  source 1..20: mol_type = other DNA
tcttgaggtggccttctgac

SEQ ID NO: 2115 - DNA, 20 bp, Synthetic construct
  source 1..20: mol_type = other DNA
ttctgctcgggcccctcatg

SEQ ID NO: 2116 - DNA, 20 bp, Synthetic construct
  source 1..20: mol_type = other DNA
ggtgggtgccgtctggcagg

SEQ ID NO: 2117 - DNA, 20 bp, Synthetic construct
  source 1..20: mol_type = other DNA
tggagggcgatgtagtaggt

SEQ ID NO: 2118 - DNA, 20 bp, Synthetic construct
  source 1..20: mol_type = other DNA
gtctgagtctcagttttcct

SEQ ID NO: 2119 - DNA, 20 bp, Synthetic construct
  source 1..20: mol_type = other DNA
acctcataaaaaccaaaaga

SEQ ID NO: 2120 - DNA, 20 bp, Synthetic construct
  source 1..20: mol_type = other DNA
taggcagcatagggatatcc

SEQ ID NO: 2121 - DNA, 20 bp, Synthetic construct
  source 1..20: mol_type = other DNA
ggactgagacacttgagtca

SEQ ID NO: 2122 - DNA, 20 bp, Synthetic construct
  source 1..20: mol_type = other DNA
gcgccatcccaattgcctcc

SEQ ID NO: 2123 - DNA, 20 bp, Synthetic construct
  source 1..20: mol_type = other DNA
ctgtttcagcatcttcaaga

SEQ ID NO: 2124 - DNA, 20 bp, Synthetic construct
  source 1..20: mol_type = other DNA
tgggacaaagtcatgccctg

SEQ ID NO: 2125 - DNA, 20 bp, Synthetic construct
  source 1..20: mol_type = other DNA
gcctggtatgacacagcaag

SEQ ID NO: 2126 - DNA, 20 bp, Synthetic construct
  source 1..20: mol_type = other DNA
ctacctagaatactgggtac

SEQ ID NO: 2127 - DNA, 20 bp, Synthetic construct
  source 1..20: mol_type = other DNA
tgagccagtgtcttcacttt

SEQ ID NO: 2128 - DNA, 20 bp, Synthetic construct
  source 1..20: mol_type = other DNA
agcagtgccctgaagattag

SEQ ID NO: 2129 - DNA, 20 bp, Synthetic construct
  source 1..20: mol_type = other DNA
tttccccgtctttggtgctt

SEQ ID NO: 2130 - DNA, 20 bp, Synthetic construct
  source 1..20: mol_type = other DNA
ccatttacaatctggtgagc

SEQ ID NO: 2131 - DNA, 20 bp, Synthetic construct
  source 1..20: mol_type = other DNA
tcctgggaaaatgacgcagt

SEQ ID NO: 2132 - DNA, 20 bp, Synthetic construct
  source 1..20: mol_type = other DNA
tcccagtgacaggaagaggt

SEQ ID NO: 2133 - DNA, 20 bp, Synthetic construct
  source 1..20: mol_type = other DNA
atcctctgaactgagtcagc

SEQ ID NO: 2134 - DNA, 20 bp, Synthetic construct
  source 1..20: mol_type = other DNA
gaacataaaactttattcac

SEQ ID NO: 2135 - DNA, 20 bp, Synthetic construct
  source 1..20: mol_type = other DNA
tccagtgcccttcccacgag

SEQ ID NO: 2136 - DNA, 20 bp, Synthetic construct
  source 1..20: mol_type = other DNA
tagaagtaccctggtatgat

SEQ ID NO: 2137 - DNA, 20 bp, Synthetic construct
  source 1..20: mol_type = other DNA
ttgccccctgtagtgacaag

SEQ ID NO: 2138 - DNA, 20 bp, Synthetic construct
  source 1..20: mol_type = other DNA
attcagccccttctgctcac

SEQ ID NO: 2139 - DNA, 20 bp, Synthetic construct
  source 1..20: mol_type = other DNA
ctgctttccccagtagggag

SEQ ID NO: 2140 - DNA, 20 bp, Synthetic construct
  source 1..20: mol_type = other DNA
cttcaccccagaatccaatc

SEQ ID NO: 2141 - DNA, 20 bp, Synthetic construct
  source 1..20: mol_type = other DNA
tggcaggcagtcacctgtgc

SEQ ID NO: 2142 - DNA, 20 bp, Synthetic construct
  source 1..20: mol_type = other DNA
gaaggcacacatgcatgtcc

SEQ ID NO: 2143 - DNA, 20 bp, Synthetic construct
  source 1..20: mol_type = other DNA
acctgcttctgctcacacag

SEQ ID NO: 2144 - DNA, 20 bp, Synthetic construct
  source 1..20: mol_type = other DNA
ttctgaggacacttgaatac

SEQ ID NO: 2145 - DNA, 20 bp, Synthetic construct
  source 1..20: mol_type = other DNA
tctgcttcctggagtggcag

SEQ ID NO: 2146 - DNA, 20 bp, Synthetic construct
  source 1..20: mol_type = other DNA
tctctcctctctctgagtgt

SEQ ID NO: 2147 - DNA, 20 bp, Synthetic construct
  source 1..20: mol_type = other DNA
ctcttgtctctttccgtctc

SEQ ID NO: 2148 - DNA, 20 bp, Synthetic construct
  source 1..20: mol_type = other DNA
aagcggtaccagggctcagg

SEQ ID NO: 2149 - DNA, 20 bp, Synthetic construct
  source 1..20: mol_type = other DNA
tattctcccagcttcctcca

SEQ ID NO: 2150 - DNA, 20 bp, Synthetic construct
  source 1..20: mol_type = other DNA
ttttgaaagcaatagtgcct

SEQ ID NO: 2151 - DNA, 20 bp, Synthetic construct
  source 1..20: mol_type = other DNA
tagaacagaacagtatcagc

SEQ ID NO: 2152 - DNA, 20 bp, Synthetic construct
  source 1..20: mol_type = other DNA
tacttcatagtaaggtaatc

SEQ ID NO: 2153 - DNA, 20 bp, Synthetic construct
  source 1..20: mol_type = other DNA
cccaaaacagactggcagag

SEQ ID NO: 2154 - DNA, 20 bp, Synthetic construct
  source 1..20: mol_type = other DNA
atatcacaccttccaggtca

SEQ ID NO: 2155 - DNA, 20 bp, Synthetic construct
  source 1..20: mol_type = other DNA
acatataagctctgagctgt

SEQ ID NO: 2156 - DNA, 20 bp, Synthetic construct
  source 1..20: mol_type = other DNA
cgtgcctgtcctgcctagcc

SEQ ID NO: 2157 - DNA, 20 bp, Synthetic construct
  source 1..20: mol_type = other DNA
acactcctcagctaggtgcc

SEQ ID NO: 2158 - DNA, 20 bp, Synthetic construct
  source 1..20: mol_type = other DNA
ttctcccctgcctgcaggga

SEQ ID NO: 2159 - DNA, 20 bp, Synthetic construct
  source 1..20: mol_type = other DNA
tgaatgaacagtgccacaga

SEQ ID NO: 2160 - DNA, 20 bp, Synthetic construct
  source 1..20: mol_type = other DNA
gcaccccagttaaccccagg

SEQ ID NO: 2161 - DNA, 20 bp, Synthetic construct
  source 1..20: mol_type = other DNA
cccgtccccgtcctgccctg

SEQ ID NO: 2162 - DNA, 20 bp, Synthetic construct
  source 1..20: mol_type = other DNA
aggtttcgaggcccggcccc

SEQ ID NO: 2163 - DNA, 20 bp, Synthetic construct
  source 1..20: mol_type = other DNA
gatctgcacacaaggctgaa

SEQ ID NO: 2164 - DNA, 20 bp, Synthetic construct
  source 1..20: mol_type = other DNA
gaggcctaatcaatattggt

SEQ ID NO: 2165 - DNA, 20 bp, Synthetic construct
  source 1..20: mol_type = other DNA
gatgggtgaggtgaggagtc

SEQ ID NO: 2166 - DNA, 20 bp, Synthetic construct
  source 1..20: mol_type = other DNA
cgcatgtctatctgaaggaa

SEQ ID NO: 2167 - DNA, 20 bp, Synthetic construct
  source 1..20: mol_type = other DNA
tcctgaaagaaagcagaggg

SEQ ID NO: 2168 - DNA, 20 bp, Synthetic construct
  source 1..20: mol_type = other DNA
gtaaaaagtaatttagctcc

SEQ ID NO: 2169 - DNA, 20 bp, Synthetic construct
  source 1..20: mol_type = other DNA
aattttgttccttagctaag

SEQ ID NO: 2170 - DNA, 20 bp, Synthetic construct
  source 1..20: mol_type = other DNA
tggtcctaaatattctagtc

SEQ ID NO: 2171 - DNA, 20 bp, Synthetic construct
  source 1..20: mol_type = other DNA
gtcagcctggttagcctttc

SEQ ID NO: 2172 - DNA, 20 bp, Synthetic construct
  source 1..20: mol_type = other DNA
ggatttggcagtattacctc

SEQ ID NO: 2173 - DNA, 20 bp, Synthetic construct
  source 1..20: mol_type = other DNA
gctttagtgacctgtgacta

SEQ ID NO: 2174 - DNA, 20 bp, Synthetic construct
  source 1..20: mol_type = other DNA
tacttctctctgccatttat

SEQ ID NO: 2175 - DNA, 20 bp, Synthetic construct
  source 1..20: mol_type = other DNA
caattaactaaaataaaggc

SEQ ID NO: 2176 - DNA, 20 bp, Synthetic construct
  source 1..20: mol_type = other DNA
ggatcaggagaccagagctc

SEQ ID NO: 2177 - DNA, 20 bp, Synthetic construct
  source 1..20: mol_type = other DNA
acccagcacggtattgaaat

SEQ ID NO: 2178 - DNA, 20 bp, Synthetic construct
  source 1..20: mol_type = other DNA
ccaaatcccaatagtgctgc

SEQ ID NO: 2179 - DNA, 20 bp, Synthetic construct
  source 1..20: mol_type = other DNA
atcctctcccatgcccggct

SEQ ID NO: 2180 - DNA, 20 bp, Synthetic construct
  source 1..20: mol_type = other DNA
tgtgccagccccaggctttc

SEQ ID NO: 2181 - DNA, 20 bp, Synthetic construct
  source 1..20: mol_type = other DNA
ggctccccttagaacagcct

SEQ ID NO: 2182 - DNA, 20 bp, Synthetic construct
  source 1..20: mol_type = other DNA
agtgtgtattaggatcccat

SEQ ID NO: 2183 - DNA, 20 bp, Synthetic construct
  source 1..20: mol_type = other DNA
aagtgaaagctactaacttt

SEQ ID NO: 2184 - DNA, 20 bp, Synthetic construct
  source 1..20: mol_type = other DNA
aaatcccctcttcccattcc

SEQ ID NO: 2185 - DNA, 20 bp, Synthetic construct
  source 1..20: mol_type = other DNA
agataacactgggaaagcat

SEQ ID NO: 2186 - DNA, 20 bp, Synthetic construct
  source 1..20: mol_type = other DNA
ggtccaccaccacgaggctg

SEQ ID NO: 2187 - DNA, 20 bp, Synthetic construct
  source 1..20: mol_type = other DNA
ggagaaatccacccgggtcg

SEQ ID NO: 2188 - DNA, 20 bp, Synthetic construct
  source 1..20: mol_type = other DNA
tcgcagctcagcctggtaga

SEQ ID NO: 2189 - DNA, 20 bp, Synthetic construct
  source 1..20: mol_type = other DNA
tcaagaaccggatctcctcc

SEQ ID NO: 2190 - DNA, 20 bp, Synthetic construct
  source 1..20: mol_type = other DNA
ggtcaaggactgcaactggc

SEQ ID NO: 2191 - DNA, 20 bp, Synthetic construct
  source 1..20: mol_type = other DNA
atgttcctcttgaggtggcc

SEQ ID NO: 2192 - DNA, 20 bp, Synthetic construct
  source 1..20: mol_type = other DNA
cttctgctcgggcccctcat

SEQ ID NO: 2193 - DNA, 20 bp, Synthetic construct
  source 1..20: mol_type = other DNA
ttcttgttagttggagttgc

SEQ ID NO: 2194 - DNA, 20 bp, Synthetic construct
  source 1..20: mol_type = other DNA
atgtggagggcgatgtagta

SEQ ID NO: 2195 - DNA, 20 bp, Synthetic construct
  source 1..20: mol_type = other DNA
ccctttcctgtctgagtctc

SEQ ID NO: 2196 - DNA, 20 bp, Synthetic construct
  source 1..20: mol_type = other DNA
cacctcataaaaaccaaaag

SEQ ID NO: 2197 - DNA, 20 bp, Synthetic construct
  source 1..20: mol_type = other DNA
gaacaaccctctgagctggg

SEQ ID NO: 2198 - DNA, 20 bp, Synthetic construct
  source 1..20: mol_type = other DNA
atggcagctcaggtggactg

SEQ ID NO: 2199 - DNA, 20 bp, Synthetic construct
  source 1..20: mol_type = other DNA
cctacttgtatgcctagcgc

SEQ ID NO: 2200 - DNA, 20 bp, Synthetic construct
  source 1..20: mol_type = other DNA
cctgtttcagcatcttcaag

SEQ ID NO: 2201 - DNA, 20 bp, Synthetic construct
  source 1..20: mol_type = other DNA
atgggacaaagtcatgccct

SEQ ID NO: 2202 - DNA, 20 bp, Synthetic construct
  source 1..20: mol_type = other DNA
aagaagcagcagtcccaggg

SEQ ID NO: 2203 - DNA, 20 bp, Synthetic construct
  source 1..20: mol_type = other DNA
gcactacctagaatactggg

SEQ ID NO: 2204 - DNA, 20 bp, Synthetic construct
  source 1..20: mol_type = other DNA
atgagccagtgtcttcactt

SEQ ID NO: 2205 - DNA, 20 bp, Synthetic construct
  source 1..20: mol_type = other DNA
gcagcagtgccctgaagatt

SEQ ID NO: 2206 - DNA, 20 bp, Synthetic construct
  source 1..20: mol_type = other DNA
ttttccccgtctttggtgct

SEQ ID NO: 2207 - DNA, 20 bp, Synthetic construct
  source 1..20: mol_type = other DNA
tccatttacaatctggtgag

SEQ ID NO: 2208 - DNA, 20 bp, Synthetic construct
  source 1..20: mol_type = other DNA
ttcctgggaaaatgacgcag

SEQ ID NO: 2209 - DNA, 20 bp, Synthetic construct
  source 1..20: mol_type = other DNA
cctcccagtgacaggaagag

SEQ ID NO: 2210 - DNA, 20 bp, Synthetic construct
  source 1..20: mol_type = other DNA
aatcctctgaactgagtcag

SEQ ID NO: 2211 - DNA, 20 bp, Synthetic construct
  source 1..20: mol_type = other DNA
ggaacataaaactttattca

SEQ ID NO: 2212 - DNA, 20 bp, Synthetic construct
  source 1..20: mol_type = other DNA
actccagtgcccttcccacg

SEQ ID NO: 2213 - DNA, 20 bp, Synthetic construct
  source 1..20: mol_type = other DNA
ctagaagtaccctggtatga

SEQ ID NO: 2214 - DNA, 20 bp, Synthetic construct
  source 1..20: mol_type = other DNA
ttttgccccctgtagtgaca

SEQ ID NO: 2215 - DNA, 20 bp, Synthetic construct
  source 1..20: mol_type = other DNA
tccctgagacttctcgggca

SEQ ID NO: 2216 - DNA, 20 bp, Synthetic construct
  source 1..20: mol_type = other DNA
actgctttccccagtaggga

SEQ ID NO: 2217 - DNA, 20 bp, Synthetic construct
  source 1..20: mol_type = other DNA
ctttcttcaccccagaatcc

SEQ ID NO: 2218 - DNA, 20 bp, Synthetic construct
  source 1..20: mol_type = other DNA
gtggcaggcagtcacctgtg

SEQ ID NO: 2219 - DNA, 20 bp, Synthetic construct
  source 1..20: mol_type = other DNA
tgaaggcacacatgcatgtc

SEQ ID NO: 2220 - DNA, 20 bp, Synthetic construct
  source 1..20: mol_type = other DNA
cacctgcttctgctcacaca

SEQ ID NO: 2221 - DNA, 20 bp, Synthetic construct
  source 1..20: mol_type = other DNA
cctgacctgtctataggcag

SEQ ID NO: 2222 - DNA, 20 bp, Synthetic construct
  source 1..20: mol_type = other DNA
atctgcttcctggagtggca

SEQ ID NO: 2223 - DNA, 20 bp, Synthetic construct
  source 1..20: mol_type = other DNA
ttctctcctctctctgagtg

SEQ ID NO: 2224 - DNA, 20 bp, Synthetic construct
  source 1..20: mol_type = other DNA
ctctcttgtctctttccgtc

SEQ ID NO: 2225 - DNA, 20 bp, Synthetic construct
  source 1..20: mol_type = other DNA
gaagcggtaccagggctcag

SEQ ID NO: 2226 - DNA, 20 bp, Synthetic construct
  source 1..20: mol_type = other DNA
atattctcccagcttcctcc

SEQ ID NO: 2227 - DNA, 20 bp, Synthetic construct
  source 1..20: mol_type = other DNA
ggtacttttgaaagcaatag

SEQ ID NO: 2228 - DNA, 20 bp, Synthetic construct
  source 1..20: mol_type = other DNA
ggcttagaacagaacagtat

SEQ ID NO: 2229 - DNA, 20 bp, Synthetic construct
  source 1..20: mol_type = other DNA
cagcacctacttcatagtaa

SEQ ID NO: 2230 - DNA, 20 bp, Synthetic construct
  source 1..20: mol_type = other DNA
gaggctcagtaacccaaaac

SEQ ID NO: 2231 - DNA, 20 bp, Synthetic construct
  source 1..20: mol_type = other DNA
aatatcacaccttccaggtc

SEQ ID NO: 2232 - DNA, 20 bp, Synthetic construct
  source 1..20: mol_type = other DNA
ctacatataagctctgagct

SEQ ID NO: 2233 - DNA, 20 bp, Synthetic construct
  source 1..20: mol_type = other DNA
aggaatggccctcccttctt

SEQ ID NO: 2234 - DNA, 20 bp, Synthetic construct
  source 1..20: mol_type = other DNA
cacactcctcagctaggtgc

SEQ ID NO: 2235 - DNA, 20 bp, Synthetic construct
  source 1..20: mol_type = other DNA
gccctttctcccctgcctgc

SEQ ID NO: 2236 - DNA, 20 bp, Synthetic construct
  source 1..20: mol_type = other DNA
aatgaatgaacagtgccaca

SEQ ID NO: 2237 - DNA, 20 bp, Synthetic construct
  source 1..20: mol_type = other DNA
gtgagcagcaccccagttaa

SEQ ID NO: 2238 - DNA, 20 bp, Synthetic construct
  source 1..20: mol_type = other DNA
tccgcccgtccccgtcctgc

SEQ ID NO: 2239 - DNA, 20 bp, Synthetic construct
  source 1..20: mol_type = other DNA
gaggtttcgaggcccggccc

SEQ ID NO: 2240 - DNA, 20 bp, Synthetic construct
  source 1..20: mol_type = other DNA
ggatctgcacacaaggctga

SEQ ID NO: 2241 - DNA, 20 bp, Synthetic construct
  source 1..20: mol_type = other DNA
tgaggcctaatcaatattgg

SEQ ID NO: 2242 - DNA, 20 bp, Synthetic construct
  source 1..20: mol_type = other DNA
agagatgggtgaggtgagga

SEQ ID NO: 2243 - DNA, 20 bp, Synthetic construct
  source 1..20: mol_type = other DNA
cttgagtgttatctgggagg

SEQ ID NO: 2244 - DNA, 20 bp, Synthetic construct
  source 1..20: mol_type = other DNA
gggaatggtgatcctgaaag

SEQ ID NO: 2245 - DNA, 20 bp, Synthetic construct
  source 1..20: mol_type = other DNA
aagtaaaaagtaatttagct

SEQ ID NO: 2246 - DNA, 20 bp, Synthetic construct
  source 1..20: mol_type = other DNA
gaattttgttccttagctaa

SEQ ID NO: 2247 - DNA, 20 bp, Synthetic construct
  source 1..20: mol_type = other DNA
gagacatgcatatctagtgg

SEQ ID NO: 2248 - DNA, 20 bp, Synthetic construct
  source 1..20: mol_type = other DNA
tagtcagcctggttagcctt

SEQ ID NO: 2249 - DNA, 20 bp, Synthetic construct
  source 1..20: mol_type = other DNA
tatctaggatttggcagtat

SEQ ID NO: 2250 - DNA, 20 bp, Synthetic construct
  source 1..20: mol_type = other DNA
gtgctttagtgacctgtgac

SEQ ID NO: 2251 - DNA, 20 bp, Synthetic construct
  source 1..20: mol_type = other DNA
cctacttctctctgccattt

SEQ ID NO: 2252 - DNA, 20 bp, Synthetic construct
  source 1..20: mol_type = other DNA
acaattaactaaaataaagg

SEQ ID NO: 2253 - DNA, 20 bp, Synthetic construct
  source 1..20: mol_type = other DNA
gtaatccccttactcgggag

SEQ ID NO: 2254 - DNA, 20 bp, Synthetic construct
  source 1..20: mol_type = other DNA
aacccagcacggtattgaaa

SEQ ID NO: 2255 - DNA, 20 bp, Synthetic construct
  source 1..20: mol_type = other DNA
cccaaatcccaatagtgctg

SEQ ID NO: 2256 - DNA, 20 bp, Synthetic construct
  source 1..20: mol_type = other DNA
agccatcctctcccatgccc

SEQ ID NO: 2257 - DNA, 20 bp, Synthetic construct
  source 1..20: mol_type = other DNA
tctatgtgccagccccaggc

SEQ ID NO: 2258 - DNA, 20 bp, Synthetic construct
  source 1..20: mol_type = other DNA
aggctccccttagaacagcc

SEQ ID NO: 2259 - DNA, 20 bp, Synthetic construct
  source 1..20: mol_type = other DNA
gagtgtgtattaggatccca

SEQ ID NO: 2260 - DNA, 20 bp, Synthetic construct
  source 1..20: mol_type = other DNA
ggaagtgaaagctactaact

SEQ ID NO: 2261 - DNA, 20 bp, Synthetic construct
  source 1..20: mol_type = other DNA
ccaaatcccctcttcccatt

SEQ ID NO: 2262 - DNA, 20 bp, Synthetic construct
  source 1..20: mol_type = other DNA
tgagataacactgggaaagc

SEQ ID NO: 2263 - DNA, 20 bp, Synthetic construct
  source 1..20: mol_type = other DNA
accccaggtccaccaccacg

SEQ ID NO: 2264 - DNA, 20 bp, Synthetic construct
  source 1..20: mol_type = other DNA
tgccccagccagggagaaat

SEQ ID NO: 2265 - DNA, 20 bp, Synthetic construct
  source 1..20: mol_type = other DNA
ctcgcagctcagcctggtag

SEQ ID NO: 2266 - DNA, 20 bp, Synthetic construct
  source 1..20: mol_type = other DNA
ttcctcaagaaccggatctc

SEQ ID NO: 2267 - DNA, 20 bp, Synthetic construct
  source 1..20: mol_type = other DNA
cgcaggtcaaggactgcaac

SEQ ID NO: 2268 - DNA, 20 bp, Synthetic construct
  source 1..20: mol_type = other DNA
gatgttcctcttgaggtggc

SEQ ID NO: 2269 - DNA, 20 bp, Synthetic construct
  source 1..20: mol_type = other DNA
gcttctgctcgggcccctca

SEQ ID NO: 2270 - DNA, 20 bp, Synthetic construct
  source 1..20: mol_type = other DNA
gtttcttgttagttggagtt

SEQ ID NO: 2271 - DNA, 20 bp, Synthetic construct
  source 1..20: mol_type = other DNA
gatgtggagggcgatgtagt

SEQ ID NO: 2272 - DNA, 20 bp, Synthetic construct
  source 1..20: mol_type = other DNA
ttccctttcctgtctgagtc

SEQ ID NO: 2273 - DNA, 20 bp, Synthetic construct
  source 1..20: mol_type = other DNA
ccacctcataaaaaccaaaa

SEQ ID NO: 2274 - DNA, 20 bp, Synthetic construct
  source 1..20: mol_type = other DNA
agaacaaccctctgagctgg

SEQ ID NO: 2275 - DNA, 20 bp, Synthetic construct
  source 1..20: mol_type = other DNA
caagtgctgagaatcaagct

SEQ ID NO: 2276 - DNA, 20 bp, Synthetic construct
  source 1..20: mol_type = other DNA
tccagaggccaagtgcaact

SEQ ID NO: 2277 - DNA, 20 bp, Synthetic construct
  source 1..20: mol_type = other DNA
tcctgtttcagcatcttcaa

SEQ ID NO: 2278 - DNA, 20 bp, Synthetic construct
  source 1..20: mol_type = other DNA
aatgggacaaagtcatgccc

SEQ ID NO: 2279 - DNA, 20 bp, Synthetic construct
  source 1..20: mol_type = other DNA
aaaagcagccggtcactatg

SEQ ID NO: 2280 - DNA, 20 bp, Synthetic construct
  source 1..20: mol_type = other DNA
agggcactacctagaatact

SEQ ID NO: 2281 - DNA, 20 bp, Synthetic construct
  source 1..20: mol_type = other DNA
cagccctgagcacccggcct

SEQ ID NO: 2282 - DNA, 20 bp, Synthetic construct
  source 1..20: mol_type = other DNA
cagcagcagtgccctgaaga

SEQ ID NO: 2283 - DNA, 20 bp, Synthetic construct
  source 1..20: mol_type = other DNA
attttccccgtctttggtgc

SEQ ID NO: 2284 - DNA, 20 bp, Synthetic construct
  source 1..20: mol_type = other DNA
ggcaggcagctaaccgcgag

SEQ ID NO: 2285 - DNA, 20 bp, Synthetic construct
  source 1..20: mol_type = other DNA
gttcctgggaaaatgacgca

SEQ ID NO: 2286 - DNA, 20 bp, Synthetic construct
  source 1..20: mol_type = other DNA
gccctcccagtgacaggaag

SEQ ID NO: 2287 - DNA, 20 bp, Synthetic construct
  source 1..20: mol_type = other DNA
aagaatcctctgaactgagt

SEQ ID NO: 2288 - DNA, 20 bp, Synthetic construct
  source 1..20: mol_type = other DNA
gggaacataaaactttattc

SEQ ID NO: 2289 - DNA, 20 bp, Synthetic construct
  source 1..20: mol_type = other DNA
ggactccagtgcccttccca

SEQ ID NO: 2290 - DNA, 20 bp, Synthetic construct
  source 1..20: mol_type = other DNA
cctagaagtaccctggtatg

SEQ ID NO: 2291 - DNA, 20 bp, Synthetic construct
  source 1..20: mol_type = other DNA
gcttttgccccctgtagtga

SEQ ID NO: 2292 - DNA, 20 bp, Synthetic construct
  source 1..20: mol_type = other DNA
ctccctgagacttctcgggc

SEQ ID NO: 2293 - DNA, 20 bp, Synthetic construct
  source 1..20: mol_type = other DNA
gcactgctttccccagtagg

SEQ ID NO: 2294 - DNA, 20 bp, Synthetic construct
  source 1..20: mol_type = other DNA
actttcttcaccccagaatc

SEQ ID NO: 2295 - DNA, 20 bp, Synthetic construct
  source 1..20: mol_type = other DNA
agtcaaagtaacttgatggg

SEQ ID NO: 2296 - DNA, 20 bp, Synthetic construct
  source 1..20: mol_type = other DNA
ttgaaggcacacatgcatgt

SEQ ID NO: 2297 - DNA, 20 bp, Synthetic construct
  source 1..20: mol_type = other DNA
aggatgagcagatgtgggct

SEQ ID NO: 2298 - DNA, 20 bp, Synthetic construct
  source 1..20: mol_type = other DNA
ccctgacctgtctataggca

SEQ ID NO: 2299 - DNA, 20 bp, Synthetic construct
  source 1..20: mol_type = other DNA
tcatctgcttcctggagtgg

SEQ ID NO: 2300 - DNA, 20 bp, Synthetic construct
  source 1..20: mol_type = other DNA
tttctctcctctctctgagt

SEQ ID NO: 2301 - DNA, 20 bp, Synthetic construct
  source 1..20: mol_type = other DNA
aatgctctcttgtctctttc

SEQ ID NO: 2302 - DNA, 20 bp, Synthetic construct
  source 1..20: mol_type = other DNA
agaagcggtaccagggctca

SEQ ID NO: 2303 - DNA, 20 bp, Synthetic construct
  source 1..20: mol_type = other DNA
agtcagtcacctggagagga

SEQ ID NO: 2304 - DNA, 20 bp, Synthetic construct
  source 1..20: mol_type = other DNA
taatgggtacttttgaaagc

SEQ ID NO: 2305 - DNA, 20 bp, Synthetic construct
  source 1..20: mol_type = other DNA
gggcttagaacagaacagta

SEQ ID NO: 2306 - DNA, 20 bp, Synthetic construct
  source 1..20: mol_type = other DNA
acagcacctacttcatagta

SEQ ID NO: 2307 - DNA, 20 bp, Synthetic construct
  source 1..20: mol_type = other DNA
tagaggctcagtaacccaaa

SEQ ID NO: 2308 - DNA, 20 bp, Synthetic construct
  source 1..20: mol_type = other DNA
caatatcacaccttccaggt

SEQ ID NO: 2309 - DNA, 20 bp, Synthetic construct
  source 1..20: mol_type = other DNA
cactacatataagctctgag

SEQ ID NO: 2310 - DNA, 20 bp, Synthetic construct
  source 1..20: mol_type = other DNA
taggaatggccctcccttct

SEQ ID NO: 2311 - DNA, 20 bp, Synthetic construct
  source 1..20: mol_type = other DNA
actcacactcctcagctagg

SEQ ID NO: 2312 - DNA, 20 bp, Synthetic construct
  source 1..20: mol_type = other DNA
taatagccctttctcccctg

SEQ ID NO: 2313 - DNA, 20 bp, Synthetic construct
  source 1..20: mol_type = other DNA
cgaatgaatgaacagtgcca

SEQ ID NO: 2314 - DNA, 20 bp, Synthetic construct
  source 1..20: mol_type = other DNA
agggaggtgagcagcacccc

SEQ ID NO: 2315 - DNA, 20 bp, Synthetic construct
  source 1..20: mol_type = other DNA
gctccgcccgtccccgtcct

SEQ ID NO: 2316 - DNA, 20 bp, Synthetic construct
  source 1..20: mol_type = other DNA
ggaggtttcgaggcccggcc

SEQ ID NO: 2317 - DNA, 20 bp, Synthetic construct
  source 1..20: mol_type = other DNA
gggatctgcacacaaggctg

SEQ ID NO: 2318 - DNA, 20 bp, Synthetic construct
  source 1..20: mol_type = other DNA
ttgaggcctaatcaatattg

SEQ ID NO: 2319 - DNA, 20 bp, Synthetic construct
  source 1..20: mol_type = other DNA
gaagagatgggtgaggtgag

SEQ ID NO: 2320 - DNA, 20 bp, Synthetic construct
  source 1..20: mol_type = other DNA
ctttttccccagcagccaac

SEQ ID NO: 2321 - DNA, 20 bp, Synthetic construct
  source 1..20: mol_type = other DNA
tcacattcactaatatttaa

SEQ ID NO: 2322 - DNA, 20 bp, Synthetic construct
  source 1..20: mol_type = other DNA
caagtaaaaagtaatttagc

SEQ ID NO: 2323 - DNA, 20 bp, Synthetic construct
  source 1..20: mol_type = other DNA
agaggaattttgttccttag

SEQ ID NO: 2324 - DNA, 20 bp, Synthetic construct
  source 1..20: mol_type = other DNA
tcctgagacatgcatatcta

SEQ ID NO: 2325 - DNA, 20 bp, Synthetic construct
  source 1..20: mol_type = other DNA
actagtcagcctggttagcc

SEQ ID NO: 2326 - DNA, 20 bp, Synthetic construct
  source 1..20: mol_type = other DNA
actatctaggatttggcagt

SEQ ID NO: 2327 - DNA, 20 bp, Synthetic construct
  source 1..20: mol_type = other DNA
ctgtgctttagtgacctgtg

SEQ ID NO: 2328 - DNA, 20 bp, Synthetic construct
  source 1..20: mol_type = other DNA
agtgctcaatacacataggt

SEQ ID NO: 2329 - DNA, 20 bp, Synthetic construct
  source 1..20: mol_type = other DNA
gacaattaactaaaataaag

SEQ ID NO: 2330 - DNA, 20 bp, Synthetic construct
  source 1..20: mol_type = other DNA
actccgtcgaaagcaggcaa

SEQ ID NO: 2331 - DNA, 20 bp, Synthetic construct
  source 1..20: mol_type = other DNA
aaacccagcacggtattgaa

SEQ ID NO: 2332 - DNA, 20 bp, Synthetic construct
  source 1..20: mol_type = other DNA
tcttccaaacgggctggaga

SEQ ID NO: 2333 - DNA, 20 bp, Synthetic construct
  source 1..20: mol_type = other DNA
catgagccatcctctcccat

SEQ ID NO: 2334 - DNA, 20 bp, Synthetic construct
  source 1..20: mol_type = other DNA
ttgctgggaaccttctatgt

SEQ ID NO: 2335 - DNA, 20 bp, Synthetic construct
  source 1..20: mol_type = other DNA
aaggctccccttagaacagc

SEQ ID NO: 2336 - DNA, 20 bp, Synthetic construct
  source 1..20: mol_type = other DNA
agagtgtgtattaggatccc

SEQ ID NO: 2337 - DNA, 20 bp, Synthetic construct
  source 1..20: mol_type = other DNA
gagttggaagtgaaagctac

SEQ ID NO: 2338 - DNA, 20 bp, Synthetic construct
  source 1..20: mol_type = other DNA
cgtggcggatacgccaaatc

SEQ ID NO: 2339 - DNA, 20 bp, Synthetic construct
  source 1..20: mol_type = other DNA
gtgagataacactgggaaag

SEQ ID NO: 2340 - DNA, 20 bp, Synthetic construct
  source 1..20: mol_type = other DNA
ttcacacagaccccaggtcc

SEQ ID NO: 2341 - DNA, 20 bp, Synthetic construct
  source 1..20: mol_type = other DNA
gagtgccccagccagggaga

SEQ ID NO: 2342 - DNA, 20 bp, Synthetic construct
  source 1..20: mol_type = other DNA
gcggtgagttgatcgagccg

SEQ ID NO: 2343 - DNA, 20 bp, Synthetic construct
  source 1..20: mol_type = other DNA
cttcctcaagaaccggatct

SEQ ID NO: 2344 - DNA, 20 bp, Synthetic construct
  source 1..20: mol_type = other DNA
gtcgcaggtcaaggactgca

SEQ ID NO: 2345 - DNA, 20 bp, Synthetic construct
  source 1..20: mol_type = other DNA
gcatctccacggtcttcacc

SEQ ID NO: 2346 - DNA, 20 bp, Synthetic construct
  source 1..20: mol_type = other DNA
ctgcttctgctcgggcccct

SEQ ID NO: 2347 - DNA, 20 bp, Synthetic construct
  source 1..20: mol_type = other DNA
gagtttcttgttagttggag

SEQ ID NO: 2348 - DNA, 20 bp, Synthetic construct
  source 1..20: mol_type = other DNA
aacaggaatcagggatgtgg

SEQ ID NO: 2349 - DNA, 20 bp, Synthetic construct
  source 1..20: mol_type = other DNA
ccagggctaccttgtctgtg

SEQ ID NO: 2350 - DNA, 20 bp, Synthetic construct
  source 1..20: mol_type = other DNA
tatcccacctcataaaaacc

SEQ ID NO: 2351 - DNA, 20 bp, Synthetic construct
  source 1..20: mol_type = other DNA
taggagaacaaccctctgag

SEQ ID NO: 2352 - DNA, 20 bp, Synthetic construct
  source 1..20: mol_type = other DNA
cccaagtgctgagaatcaag

SEQ ID NO: 2353 - DNA, 20 bp, Synthetic construct
  source 1..20: mol_type = other DNA
aatccagaggccaagtgcaa

SEQ ID NO: 2354 - DNA, 20 bp, Synthetic construct
  source 1..20: mol_type = other DNA
tctctcctgtttcagcatct

SEQ ID NO: 2355 - DNA, 20 bp, Synthetic construct
  source 1..20: mol_type = other DNA
aaatgggacaaagtcatgcc

SEQ ID NO: 2356 - DNA, 20 bp, Synthetic construct
  source 1..20: mol_type = other DNA
gcttagggaaaagcagccgg

SEQ ID NO: 2357 - DNA, 20 bp, Synthetic construct
  source 1..20: mol_type = other DNA
tagggcactacctagaatac

SEQ ID NO: 2358 - DNA, 20 bp, Synthetic construct
  source 1..20: mol_type = other DNA
gtcagccctgagcacccggc

SEQ ID NO: 2359 - DNA, 20 bp, Synthetic construct
  source 1..20: mol_type = other DNA
ggcagcagcagtgccctgaa

SEQ ID NO: 2360 - DNA, 20 bp, Synthetic construct
  source 1..20: mol_type = other DNA
tgattttccccgtctttggt

SEQ ID NO: 2361 - DNA, 20 bp, Synthetic construct
  source 1..20: mol_type = other DNA
cgtgtctgagaggcaggcag

SEQ ID NO: 2362 - DNA, 20 bp, Synthetic construct
  source 1..20: mol_type = other DNA
ctgcagttcctgggaaaatg

SEQ ID NO: 2363 - DNA, 20 bp, Synthetic construct
  source 1..20: mol_type = other DNA
ggccctcccagtgacaggaa

SEQ ID NO: 2364 - DNA, 20 bp, Synthetic construct
  source 1..20: mol_type = other DNA
gaagaatcctctgaactgag

SEQ ID NO: 2365 - DNA, 20 bp, Synthetic construct
  source 1..20: mol_type = other DNA
agggaacataaaactttatt

SEQ ID NO: 2366 - DNA, 20 bp, Synthetic construct
  source 1..20: mol_type = other DNA
aggactccagtgcccttccc

SEQ ID NO: 2367 - DNA, 20 bp, Synthetic construct
  source 1..20: mol_type = other DNA
cacctagaagtaccctggta

SEQ ID NO: 2368 - DNA, 20 bp, Synthetic construct
  source 1..20: mol_type = other DNA
gtgcttttgccccctgtagt

SEQ ID NO: 2369 - DNA, 20 bp, Synthetic construct
  source 1..20: mol_type = other DNA
cctccctgagacttctcggg

SEQ ID NO: 2370 - DNA, 20 bp, Synthetic construct
  source 1..20: mol_type = other DNA
tgcactgctttccccagtag

SEQ ID NO: 2371 - DNA, 20 bp, Synthetic construct
  source 1..20: mol_type = other DNA
cactttcttcaccccagaat

SEQ ID NO: 2372 - DNA, 20 bp, Synthetic construct
  source 1..20: mol_type = other DNA
agctgtgcaagtcaaagtaa

SEQ ID NO: 2373 - DNA, 20 bp, Synthetic construct
  source 1..20: mol_type = other DNA
tgcacttgaaggcacacatg

SEQ ID NO: 2374 - DNA, 20 bp, Synthetic construct
  source 1..20: mol_type = other DNA
gaggatgagcagatgtgggc

SEQ ID NO: 2375 - DNA, 20 bp, Synthetic construct
  source 1..20: mol_type = other DNA
tccctgacctgtctataggc

SEQ ID NO: 2376 - DNA, 20 bp, Synthetic construct
  source 1..20: mol_type = other DNA
ttcatctgcttcctggagtg

SEQ ID NO: 2377 - DNA, 20 bp, Synthetic construct
  source 1..20: mol_type = other DNA
acctgccaatctctgtttct

SEQ ID NO: 2378 - DNA, 20 bp, Synthetic construct
  source 1..20: mol_type = other DNA
gaatgctctcttgtctcttt

SEQ ID NO: 2379 - DNA, 20 bp, Synthetic construct
  source 1..20: mol_type = other DNA
tgagagaagcggtaccaggg

SEQ ID NO: 2380 - DNA, 20 bp, Synthetic construct
  source 1..20: mol_type = other DNA
aaagtcagtcacctggagag

SEQ ID NO: 2381 - DNA, 20 bp, Synthetic construct
  source 1..20: mol_type = other DNA
cagtaataataatgggtact

SEQ ID NO: 2382 - DNA, 20 bp, Synthetic construct
  source 1..20: mol_type = other DNA
agggcttagaacagaacagt

SEQ ID NO: 2383 - DNA, 20 bp, Synthetic construct
  source 1..20: mol_type = other DNA
gtcaaagaacagcacctact

SEQ ID NO: 2384 - DNA, 20 bp, Synthetic construct
  source 1..20: mol_type = other DNA
ggtagaggctcagtaaccca

SEQ ID NO: 2385 - DNA, 20 bp, Synthetic construct
  source 1..20: mol_type = other DNA
tcaatatcacaccttccagg

SEQ ID NO: 2386 - DNA, 20 bp, Synthetic construct
  source 1..20: mol_type = other DNA
acactacatataagctctga

SEQ ID NO: 2387 - DNA, 20 bp, Synthetic construct
  source 1..20: mol_type = other DNA
tctgtcctccactaggaatg

SEQ ID NO: 2388 - DNA, 20 bp, Synthetic construct
  source 1..20: mol_type = other DNA
cactcacactcctcagctag

SEQ ID NO: 2389 - DNA, 20 bp, Synthetic construct
  source 1..20: mol_type = other DNA
ctgggttctaatagcccttt

SEQ ID NO: 2390 - DNA, 20 bp, Synthetic construct
  source 1..20: mol_type = other DNA
gcgaatgaatgaacagtgcc

SEQ ID NO: 2391 - DNA, 20 bp, Synthetic construct
  source 1..20: mol_type = other DNA
tcagggaggtgagcagcacc

SEQ ID NO: 2392 - DNA, 20 bp, Synthetic construct
  source 1..20: mol_type = other DNA
cgtccctgctccgcccgtcc

SEQ ID NO: 2393 - DNA, 20 bp, Synthetic construct
  source 1..20: mol_type = other DNA
tcccgcggagccccgacccg

SEQ ID NO: 2394 - DNA, 20 bp, Synthetic construct
  source 1..20: mol_type = other DNA
ggaagggatctgcacacaag

SEQ ID NO: 2395 - DNA, 20 bp, Synthetic construct
  source 1..20: mol_type = other DNA
ccttgaggcctaatcaatat

SEQ ID NO: 2396 - DNA, 20 bp, Synthetic construct
  source 1..20: mol_type = other DNA
agaagagatgggtgaggtga

SEQ ID NO: 2397 - DNA, 20 bp, Synthetic construct
  source 1..20: mol_type = other DNA
tctcctagctttttccccag

SEQ ID NO: 2398 - DNA, 20 bp, Synthetic construct
  source 1..20: mol_type = other DNA
cgtcacattcactaatattt

SEQ ID NO: 2399 - DNA, 20 bp, Synthetic construct
  source 1..20: mol_type = other DNA
ccaatgcaagtaaaaagtaa

SEQ ID NO: 2400 - DNA, 20 bp, Synthetic construct
  source 1..20: mol_type = other DNA
aagaggaattttgttcctta

SEQ ID NO: 2401 - DNA, 20 bp, Synthetic construct
  source 1..20: mol_type = other DNA
agtcctgagacatgcatatc

SEQ ID NO: 2402 - DNA, 20 bp, Synthetic construct
  source 1..20: mol_type = other DNA
tactagtcagcctggttagc

SEQ ID NO: 2403 - DNA, 20 bp, Synthetic construct
  source 1..20: mol_type = other DNA
gactatctaggatttggcag

SEQ ID NO: 2404 - DNA, 20 bp, Synthetic construct
  source 1..20: mol_type = other DNA
tctgtgctttagtgacctgt

SEQ ID NO: 2405 - DNA, 20 bp, Synthetic construct
  source 1..20: mol_type = other DNA
tagtgctcaatacacatagg

SEQ ID NO: 2406 - DNA, 20 bp, Synthetic construct
  source 1..20: mol_type = other DNA
agacaattaactaaaataaa

SEQ ID NO: 2407 - DNA, 20 bp, Synthetic construct
  source 1..20: mol_type = other DNA
gactccgtcgaaagcaggca

SEQ ID NO: 2408 - DNA, 20 bp, Synthetic construct
  source 1..20: mol_type = other DNA
ctgaaaacccagcacggtat

SEQ ID NO: 2409 - DNA, 20 bp, Synthetic construct
  source 1..20: mol_type = other DNA
ctcttccaaacgggctggag

SEQ ID NO: 2410 - DNA, 20 bp, Synthetic construct
  source 1..20: mol_type = other DNA
gcatgagccatcctctccca

SEQ ID NO: 2411 - DNA, 20 bp, Synthetic construct
  source 1..20: mol_type = other DNA
gttgctgggaaccttctatg

SEQ ID NO: 2412 - DNA, 20 bp, Synthetic construct
  source 1..20: mol_type = other DNA
caaggctccccttagaacag

SEQ ID NO: 2413 - DNA, 20 bp, Synthetic construct
  source 1..20: mol_type = other DNA
agagagtgtgtattaggatc

SEQ ID NO: 2414 - DNA, 20 bp, Synthetic construct
  source 1..20: mol_type = other DNA
agagttggaagtgaaagcta

SEQ ID NO: 2415 - DNA, 20 bp, Synthetic construct
  source 1..20: mol_type = other DNA
agatgagctcccactgtggt

SEQ ID NO: 2416 - DNA, 20 bp, Synthetic construct
  source 1..20: mol_type = other DNA
ggtgagataacactgggaaa

SEQ ID NO: 2417 - DNA, 20 bp, Synthetic construct
  source 1..20: mol_type = other DNA
gttcacacagaccccaggtc

SEQ ID NO: 2418 - DNA, 20 bp, Synthetic construct
  source 1..20: mol_type = other DNA
tgagtgccccagccagggag

SEQ ID NO: 2419 - DNA, 20 bp, Synthetic construct
  source 1..20: mol_type = other DNA
ggcggtgagttgatcgagcc

SEQ ID NO: 2420 - DNA, 20 bp, Synthetic construct
  source 1..20: mol_type = other DNA
tcttcctcaagaaccggatc

SEQ ID NO: 2421 - DNA, 20 bp, Synthetic construct
  source 1..20: mol_type = other DNA
cgcgcagagactccaggtcg

SEQ ID NO: 2422 - DNA, 20 bp, Synthetic construct
  source 1..20: mol_type = other DNA
ccgcatctccacggtcttca

SEQ ID NO: 2423 - DNA, 20 bp, Synthetic construct
  source 1..20: mol_type = other DNA
actatcctgcttctgctcgg

SEQ ID NO: 2424 - DNA, 20 bp, Synthetic construct
  source 1..20: mol_type = other DNA
tgagtttcttgttagttgga

SEQ ID NO: 2425 - DNA, 20 bp, Synthetic construct
  source 1..20: mol_type = other DNA
acaacaggaatcagggatgt

SEQ ID NO: 2426 - DNA, 20 bp, Synthetic construct
  source 1..20: mol_type = other DNA
ctggccagggctaccttgtc

SEQ ID NO: 2427 - DNA, 20 bp, Synthetic construct
  source 1..20: mol_type = other DNA
atatcccacctcataaaaac

SEQ ID NO: 2428 - DNA, 20 bp, Synthetic construct
  source 1..20: mol_type = other DNA
tcagggtcagtctaggagaa

SEQ ID NO: 2429 - DNA, 20 bp, Synthetic construct
  source 1..20: mol_type = other DNA
atcccccaagtgctgagaat

SEQ ID NO: 2430 - DNA, 20 bp, Synthetic construct
  source 1..20: mol_type = other DNA
cacaatccagaggccaagtg

SEQ ID NO: 2431 - DNA, 20 bp, Synthetic construct
  source 1..20: mol_type = other DNA
ttctctcctgtttcagcatc

SEQ ID NO: 2432 - DNA, 20 bp, Synthetic construct
  source 1..20: mol_type = other DNA
gaaatgggacaaagtcatgc

SEQ ID NO: 2433 - DNA, 20 bp, Synthetic construct
  source 1..20: mol_type = other DNA
ggcttagggaaaagcagccg

SEQ ID NO: 2434 - DNA, 20 bp, Synthetic construct
  source 1..20: mol_type = other DNA
atagggcactacctagaata

SEQ ID NO: 2435 - DNA, 20 bp, Synthetic construct
  source 1..20: mol_type = other DNA
tgtcagccctgagcacccgg

SEQ ID NO: 2436 - DNA, 20 bp, Synthetic construct
  source 1..20: mol_type = other DNA
agcgactaaaggcagcagca

SEQ ID NO: 2437 - DNA, 20 bp, Synthetic construct
  source 1..20: mol_type = other DNA
gtgattttccccgtctttgg

SEQ ID NO: 2438 - DNA, 20 bp, Synthetic construct
  source 1..20: mol_type = other DNA
actccctgtcaagctgggca

SEQ ID NO: 2439 - DNA, 20 bp, Synthetic construct
  source 1..20: mol_type = other DNA
cactgcagttcctgggaaaa

SEQ ID NO: 2440 - DNA, 20 bp, Synthetic construct
  source 1..20: mol_type = other DNA
tccaggcacagcgagaccca

SEQ ID NO: 2441 - DNA, 20 bp, Synthetic construct
  source 1..20: mol_type = other DNA
ggaagaatcctctgaactga

SEQ ID NO: 2442 - DNA, 20 bp, Synthetic construct
  source 1..20: mol_type = other DNA
cagggaacataaaactttat

SEQ ID NO: 2443 - DNA, 20 bp, Synthetic construct
  source 1..20: mol_type = other DNA
caggactccagtgcccttcc

SEQ ID NO: 2444 - DNA, 20 bp, Synthetic construct
  source 1..20: mol_type = other DNA
cccacctagaagtaccctgg

SEQ ID NO: 2445 - DNA, 20 bp, Synthetic construct
  source 1..20: mol_type = other DNA
tggtgcttttgccccctgta

SEQ ID NO: 2446 - DNA, 20 bp, Synthetic construct
  source 1..20: mol_type = other DNA
ggcccctccctgagacttct

SEQ ID NO: 2447 - DNA, 20 bp, Synthetic construct
  source 1..20: mol_type = other DNA
ctgcactgctttccccagta

SEQ ID NO: 2448 - DNA, 20 bp, Synthetic construct
  source 1..20: mol_type = other DNA
ctttccctcactttcttcac

SEQ ID NO: 2449 - DNA, 20 bp, Synthetic construct
  source 1..20: mol_type = other DNA
gaccaccgcttcacagctgt

SEQ ID NO: 2450 - DNA, 20 bp, Synthetic construct
  source 1..20: mol_type = other DNA
catgtcctcctgcacttgaa

SEQ ID NO: 2451 - DNA, 20 bp, Synthetic construct
  source 1..20: mol_type = other DNA
acagaggacttgtctggagg

SEQ ID NO: 2452 - DNA, 20 bp, Synthetic construct
  source 1..20: mol_type = other DNA
ctccctgacctgtctatagg

SEQ ID NO: 2453 - DNA, 20 bp, Synthetic construct
  source 1..20: mol_type = other DNA
cttcatctgcttcctggagt

SEQ ID NO: 2454 - DNA, 20 bp, Synthetic construct
  source 1..20: mol_type = other DNA
tacctgccaatctctgtttc

SEQ ID NO: 2455 - DNA, 20 bp, Synthetic construct
  source 1..20: mol_type = other DNA
tcgaatgctctcttgtctct

SEQ ID NO: 2456 - DNA, 20 bp, Synthetic construct
  source 1..20: mol_type = other DNA
ggtgagagaagcggtaccag

SEQ ID NO: 2457 - DNA, 20 bp, Synthetic construct
  source 1..20: mol_type = other DNA
tgaaagtcagtcacctggag

SEQ ID NO: 2458 - DNA, 20 bp, Synthetic construct
  source 1..20: mol_type = other DNA
gcagtaataataatgggtac

SEQ ID NO: 2459 - DNA, 20 bp, Synthetic construct
  source 1..20: mol_type = other DNA
cagggcttagaacagaacag

SEQ ID NO: 2460 - DNA, 20 bp, Synthetic construct
  source 1..20: mol_type = other DNA
ctctcatctgtcaaagaaca

SEQ ID NO: 2461 - DNA, 20 bp, Synthetic construct
  source 1..20: mol_type = other DNA
tggtagaggctcagtaaccc

SEQ ID NO: 2462 - DNA, 20 bp, Synthetic construct
  source 1..20: mol_type = other DNA
tctacgggcactatgtttgg

SEQ ID NO: 2463 - DNA, 20 bp, Synthetic construct
  source 1..20: mol_type = other DNA
cacactacatataagctctg

SEQ ID NO: 2464 - DNA, 20 bp, Synthetic construct
  source 1..20: mol_type = other DNA
ttttctgcctccaggctctg

SEQ ID NO: 2465 - DNA, 20 bp, Synthetic construct
  source 1..20: mol_type = other DNA
cttctgccactcacactcct

SEQ ID NO: 2466 - DNA, 20 bp, Synthetic construct
  source 1..20: mol_type = other DNA
gtcagtggcacaatcccggg

SEQ ID NO: 2467 - DNA, 20 bp, Synthetic construct
  source 1..20: mol_type = other DNA
gcaagcgaatgaatgaacag

SEQ ID NO: 2468 - DNA, 20 bp, Synthetic construct
  source 1..20: mol_type = other DNA
atcagggaggtgagcagcac

SEQ ID NO: 2469 - DNA, 20 bp, Synthetic construct
  source 1..20: mol_type = other DNA
ggtggccgtccctgctccgc

SEQ ID NO: 2470 - DNA, 20 bp, Synthetic construct
  source 1..20: mol_type = other DNA
tgatgagggctcaccggttc

SEQ ID NO: 2471 - DNA, 20 bp, Synthetic construct
  source 1..20: mol_type = other DNA
gctatgtgtgaggcaggcac

SEQ ID NO: 2472 - DNA, 20 bp, Synthetic construct
  source 1..20: mol_type = other DNA
acccaagtccttggccttga

SEQ ID NO: 2473 - DNA, 20 bp, Synthetic construct
  source 1..20: mol_type = other DNA
cagaagagatgggtgaggtg

SEQ ID NO: 2474 - DNA, 20 bp, Synthetic construct
  source 1..20: mol_type = other DNA
atctcctagctttttcccca

SEQ ID NO: 2475 - DNA, 20 bp, Synthetic construct
  source 1..20: mol_type = other DNA
agagagaaaaatataacacg

SEQ ID NO: 2476 - DNA, 20 bp, Synthetic construct
  source 1..20: mol_type = other DNA
tcagggccaatgcaagtaaa

SEQ ID NO: 2477 - DNA, 20 bp, Synthetic construct
  source 1..20: mol_type = other DNA
agaagaggaattttgttcct

SEQ ID NO: 2478 - DNA, 20 bp, Synthetic construct
  source 1..20: mol_type = other DNA
aagtcctgagacatgcatat

SEQ ID NO: 2479 - DNA, 20 bp, Synthetic construct
  source 1..20: mol_type = other DNA
ctactagtcagcctggttag

SEQ ID NO: 2480 - DNA, 20 bp, Synthetic construct
  source 1..20: mol_type = other DNA
tgactatctaggatttggca

SEQ ID NO: 2481 - DNA, 20 bp, Synthetic construct
  source 1..20: mol_type = other DNA
atctgtgctttagtgacctg

SEQ ID NO: 2482 - DNA, 20 bp, Synthetic construct
  source 1..20: mol_type = other DNA
ttagtgctcaatacacatag

SEQ ID NO: 2483 - DNA, 20 bp, Synthetic construct
  source 1..20: mol_type = other DNA
gagacaattaactaaaataa

SEQ ID NO: 2484 - DNA, 20 bp, Synthetic construct
  source 1..20: mol_type = other DNA
agactccgtcgaaagcaggc

SEQ ID NO: 2485 - DNA, 20 bp, Synthetic construct
  source 1..20: mol_type = other DNA
tctgaaaacccagcacggta

SEQ ID NO: 2486 - DNA, 20 bp, Synthetic construct
  source 1..20: mol_type = other DNA
gctcttccaaacgggctgga

SEQ ID NO: 2487 - DNA, 20 bp, Synthetic construct
  source 1..20: mol_type = other DNA
cagggcatgagccatcctct

SEQ ID NO: 2488 - DNA, 20 bp, Synthetic construct
  source 1..20: mol_type = other DNA
ctcctccagaattccctggg

SEQ ID NO: 2489 - DNA, 20 bp, Synthetic construct
  source 1..20: mol_type = other DNA
tttggtaccaaggctcccct

SEQ ID NO: 2490 - DNA, 20 bp, Synthetic construct
  source 1..20: mol_type = other DNA
tttgagggtgagaaagagag

SEQ ID NO: 2491 - DNA, 20 bp, Synthetic construct
  source 1..20: mol_type = other DNA
cccaactgtgtctgctagag

SEQ ID NO: 2492 - DNA, 20 bp, Synthetic construct
  source 1..20: mol_type = other DNA
aagatgagctcccactgtgg

SEQ ID NO: 2493 - DNA, 20 bp, Synthetic construct
  source 1..20: mol_type = other DNA
gtggtgagataacactggga

SEQ ID NO: 2494 - DNA, 20 bp, Synthetic construct
  source 1..20: mol_type = other DNA
aggagttcacacagacccca

SEQ ID NO: 2495 - DNA, 20 bp, Synthetic construct
  source 1..20: mol_type = other DNA
attgagtgccccagccaggg

SEQ ID NO: 2496 - DNA, 20 bp, Synthetic construct
  source 1..20: mol_type = other DNA
tctcaacctccagccgggcg

SEQ ID NO: 2497 - DNA, 20 bp, Synthetic construct
  source 1..20: mol_type = other DNA
gctcctggagttcccgaacc

SEQ ID NO: 2498 - DNA, 20 bp, Synthetic construct
  source 1..20: mol_type = other DNA
ccgcgcagagactccaggtc

SEQ ID NO: 2499 - DNA, 20 bp, Synthetic construct
  source 1..20: mol_type = other DNA
ctccttaatgacctctccat

SEQ ID NO: 2500 - DNA, 20 bp, Synthetic construct
  source 1..20: mol_type = other DNA
aggcggagcaactatcctgc

SEQ ID NO: 2501 - DNA, 20 bp, Synthetic construct
  source 1..20: mol_type = other DNA
gtgagtttcttgttagttgg

SEQ ID NO: 2502 - DNA, 20 bp, Synthetic construct
  source 1..20: mol_type = other DNA
cataacaacaggaatcaggg

SEQ ID NO: 2503 - DNA, 20 bp, Synthetic construct
  source 1..20: mol_type = other DNA
aagcctctggccagggctac

SEQ ID NO: 2504 - DNA, 20 bp, Synthetic construct
  source 1..20: mol_type = other DNA
gatatcccacctcataaaaa

SEQ ID NO: 2505 - DNA, 20 bp, Synthetic construct
  source 1..20: mol_type = other DNA
gatcagggtcagtctaggag

SEQ ID NO: 2506 - DNA, 20 bp, Synthetic construct
  source 1..20: mol_type = other DNA
acaacagatcccccaagtgc

SEQ ID NO: 2507 - DNA, 20 bp, Synthetic construct
  source 1..20: mol_type = other DNA
cccacaatccagaggccaag

SEQ ID NO: 2508 - DNA, 20 bp, Synthetic construct
  source 1..20: mol_type = other DNA
tttctctcctgtttcagcat

SEQ ID NO: 2509 - DNA, 20 bp, Synthetic construct
  source 1..20: mol_type = other DNA
agaaatgggacaaagtcatg

SEQ ID NO: 2510 - DNA, 20 bp, Synthetic construct
  source 1..20: mol_type = other DNA
cccttggcttagggaaaagc

SEQ ID NO: 2511 - DNA, 20 bp, Synthetic construct
  source 1..20: mol_type = other DNA
aatagggcactacctagaat

SEQ ID NO: 2512 - DNA, 20 bp, Synthetic construct
  source 1..20: mol_type = other DNA
gtgtcagccctgagcacccg

SEQ ID NO: 2513 - DNA, 20 bp, Synthetic construct
  source 1..20: mol_type = other DNA
cagcgactaaaggcagcagc

SEQ ID NO: 2514 - DNA, 20 bp, Synthetic construct
  source 1..20: mol_type = other DNA
gaccttgtgattttccccgt

SEQ ID NO: 2515 - DNA, 20 bp, Synthetic construct
  source 1..20: mol_type = other DNA
cactccctgtcaagctgggc

SEQ ID NO: 2516 - DNA, 20 bp, Synthetic construct
  source 1..20: mol_type = other DNA
taatgtacagttactctgta

SEQ ID NO: 2517 - DNA, 20 bp, Synthetic construct
  source 1..20: mol_type = other DNA
cctcagggatgaaagaataa

SEQ ID NO: 2518 - DNA, 20 bp, Synthetic construct
  source 1..20: mol_type = other DNA
gggaagaatcctctgaactg

SEQ ID NO: 2519 - DNA, 20 bp, Synthetic construct
  source 1..20: mol_type = other DNA
gcagggaacataaaacttta

SEQ ID NO: 2520 - DNA, 20 bp, Synthetic construct
  source 1..20: mol_type = other DNA
ctggagcaacctacaggccc

SEQ ID NO: 2521 - DNA, 20 bp, Synthetic construct
  source 1..20: mol_type = other DNA
gccccacctagaagtaccct

SEQ ID NO: 2522 - DNA, 20 bp, Synthetic construct
  source 1..20: mol_type = other DNA
tttggtgcttttgccccctg

SEQ ID NO: 2523 - DNA, 20 bp, Synthetic construct
  source 1..20: mol_type = other DNA
cggcccctccctgagacttc

SEQ ID NO: 2524 - DNA, 20 bp, Synthetic construct
  source 1..20: mol_type = other DNA
cctgcactgctttccccagt

SEQ ID NO: 2525 - DNA, 20 bp, Synthetic construct
  source 1..20: mol_type = other DNA
gctctttccctcactttctt

SEQ ID NO: 2526 - DNA, 20 bp, Synthetic construct
  source 1..20: mol_type = other DNA
tgaccaccgcttcacagctg

SEQ ID NO: 2527 - DNA, 20 bp, Synthetic construct
  source 1..20: mol_type = other DNA
cgcacatgtcctcctgcact

SEQ ID NO: 2528 - DNA, 20 bp, Synthetic construct
  source 1..20: mol_type = other DNA
gacagaggacttgtctggag

SEQ ID NO: 2529 - DNA, 20 bp, Synthetic construct
  source 1..20: mol_type = other DNA
cacctccctgacctgtctat

SEQ ID NO: 2530 - DNA, 20 bp, Synthetic construct
  source 1..20: mol_type = other DNA
ggcttcatctgcttcctgga

SEQ ID NO: 2531 - DNA, 20 bp, Synthetic construct
  source 1..20: mol_type = other DNA
cctgtctctacctgccaatc

SEQ ID NO: 2532 - DNA, 20 bp, Synthetic construct
  source 1..20: mol_type = other DNA
caggagttcgaatgctctct

SEQ ID NO: 2533 - DNA, 20 bp, Synthetic construct
  source 1..20: mol_type = other DNA
cctcctgaccagggtgagag

SEQ ID NO: 2534 - DNA, 20 bp, Synthetic construct
  source 1..20: mol_type = other DNA
ctggtgaaagtcagtcacct

SEQ ID NO: 2535 - DNA, 20 bp, Synthetic construct
  source 1..20: mol_type = other DNA
agcagtaataataatgggta

SEQ ID NO: 2536 - DNA, 20 bp, Synthetic construct
  source 1..20: mol_type = other DNA
cacagggcttagaacagaac

SEQ ID NO: 2537 - DNA, 20 bp, Synthetic construct
  source 1..20: mol_type = other DNA
tctctcatctgtcaaagaac

SEQ ID NO: 2538 - DNA, 20 bp, Synthetic construct
  source 1..20: mol_type = other DNA
atggtagaggctcagtaacc

SEQ ID NO: 2539 - DNA, 20 bp, Synthetic construct
  source 1..20: mol_type = other DNA
ctctacgggcactatgtttg

SEQ ID NO: 2540 - DNA, 20 bp, Synthetic construct
  source 1..20: mol_type = other DNA
tggctcccacactacatata

SEQ ID NO: 2541 - DNA, 20 bp, Synthetic construct
  source 1..20: mol_type = other DNA
tgcttttctgcctccaggct

SEQ ID NO: 2542 - DNA, 20 bp, Synthetic construct
  source 1..20: mol_type = other DNA
ccagtggcttctgccactca

SEQ ID NO: 2543 - DNA, 20 bp, Synthetic construct
  source 1..20: mol_type = other DNA
agcggaggcctgggtgtttt

SEQ ID NO: 2544 - DNA, 20 bp, Synthetic construct
  source 1..20: mol_type = other DNA
agcaagcgaatgaatgaaca

SEQ ID NO: 2545 - DNA, 20 bp, Synthetic construct
  source 1..20: mol_type = other DNA
aatcagggaggtgagcagca

SEQ ID NO: 2546 - DNA, 20 bp, Synthetic construct
  source 1..20: mol_type = other DNA
cccttctcccctggcatctc

SEQ ID NO: 2547 - DNA, 20 bp, Synthetic construct
  source 1..20: mol_type = other DNA
gtgaggcagcagggagactt

SEQ ID NO: 2548 - DNA, 20 bp, Synthetic construct
  source 1..20: mol_type = other DNA
gactgcctgctatgtgtgag

SEQ ID NO: 2549 - DNA, 20 bp, Synthetic construct
  source 1..20: mol_type = other DNA
tgacccaagtccttggcctt

SEQ ID NO: 2550 - DNA, 20 bp, Synthetic construct
  source 1..20: mol_type = other DNA
ggcagaagagatgggtgagg

SEQ ID NO: 2551 - DNA, 20 bp, Synthetic construct
  source 1..20: mol_type = other DNA
actccatctcctagcttttt

SEQ ID NO: 2552 - DNA, 20 bp, Synthetic construct
  source 1..20: mol_type = other DNA
cgagagagaaaaatataaca

SEQ ID NO: 2553 - DNA, 20 bp, Synthetic construct
  source 1..20: mol_type = other DNA
tttcagggccaatgcaagta

SEQ ID NO: 2554 - DNA, 20 bp, Synthetic construct
  source 1..20: mol_type = other DNA
tctagtccagaagaagagga

SEQ ID NO: 2555 - DNA, 20 bp, Synthetic construct
  source 1..20: mol_type = other DNA
atgctgaattaagtcctgag

SEQ ID NO: 2556 - DNA, 20 bp, Synthetic construct
  source 1..20: mol_type = other DNA
tctactagtcagcctggtta

SEQ ID NO: 2557 - DNA, 20 bp, Synthetic construct
  source 1..20: mol_type = other DNA
tgtgactatctaggatttgg

SEQ ID NO: 2558 - DNA, 20 bp, Synthetic construct
  source 1..20: mol_type = other DNA
tatctgtgctttagtgacct

SEQ ID NO: 2559 - DNA, 20 bp, Synthetic construct
  source 1..20: mol_type = other DNA
attagtgctcaatacacata

SEQ ID NO: 2560 - DNA, 20 bp, Synthetic construct
  source 1..20: mol_type = other DNA
ggagacaattaactaaaata

SEQ ID NO: 2561 - DNA, 20 bp, Synthetic construct
  source 1..20: mol_type = other DNA
taagactccgtcgaaagcag

SEQ ID NO: 2562 - DNA, 20 bp, Synthetic construct
  source 1..20: mol_type = other DNA
ttctgaaaacccagcacggt

SEQ ID NO: 2563 - DNA, 20 bp, Synthetic construct
  source 1..20: mol_type = other DNA
gagagagcctaggctcttcc

SEQ ID NO: 2564 - DNA, 20 bp, Synthetic construct
  source 1..20: mol_type = other DNA
tcagggcatgagccatcctc

SEQ ID NO: 2565 - DNA, 20 bp, Synthetic construct
  source 1..20: mol_type = other DNA
ttccttgctctcctccagaa

SEQ ID NO: 2566 - DNA, 20 bp, Synthetic construct
  source 1..20: mol_type = other DNA
tcccatctagtggctttggt

SEQ ID NO: 2567 - DNA, 20 bp, Synthetic construct
  source 1..20: mol_type = other DNA
tctctttctctccctggcaa

SEQ ID NO: 2568 - DNA, 20 bp, Synthetic construct
  source 1..20: mol_type = other DNA
ccatccccaactgtgtctgc

SEQ ID NO: 2569 - DNA, 20 bp, Synthetic construct
  source 1..20: mol_type = other DNA
ctgctggagtaagatgagct

SEQ ID NO: 2570 - DNA, 20 bp, Synthetic construct
  source 1..20: mol_type = other DNA
ttcttgatagtaaccacagc

SEQ ID NO: 2571 - DNA, 20 bp, Synthetic construct
  source 1..20: mol_type = other DNA
taggagttcacacagacccc

SEQ ID NO: 2572 - DNA, 20 bp, Synthetic construct
  source 1..20: mol_type = other DNA
gaagccagcattgagtgccc

SEQ ID NO: 2573 - DNA, 20 bp, Synthetic construct
  source 1..20: mol_type = other DNA
tgtgccagattgtccctctc

SEQ ID NO: 2574 - DNA, 20 bp, Synthetic construct
  source 1..20: mol_type = other DNA
cacatggacctgctgtcggg

SEQ ID NO: 2575 - DNA, 20 bp, Synthetic construct
  source 1..20: mol_type = other DNA
tgccgcgcagagactccagg

SEQ ID NO: 2576 - DNA, 20 bp, Synthetic construct
  source 1..20: mol_type = other DNA
actccttaatgacctctcca

SEQ ID NO: 2577 - DNA, 20 bp, Synthetic construct
  source 1..20: mol_type = other DNA
gaaatgtgccagcagaggcg

SEQ ID NO: 2578 - DNA, 20 bp, Synthetic construct
  source 1..20: mol_type = other DNA
gggtgagtttcttgttagtt

SEQ ID NO: 2579 - DNA, 20 bp, Synthetic construct
  source 1..20: mol_type = other DNA
agtttccataacaacaggaa

SEQ ID NO: 2580 - DNA, 20 bp, Synthetic construct
  source 1..20: mol_type = other DNA
aaaacaagcctctggccagg

SEQ ID NO: 2581 - DNA, 20 bp, Synthetic construct
  source 1..20: mol_type = other DNA
ggatatcccacctcataaaa

SEQ ID NO: 2582 - DNA, 20 bp, Synthetic construct
  source 1..20: mol_type = other DNA
cacccatcttagactgatca

SEQ ID NO: 2583 - DNA, 20 bp, Synthetic construct
  source 1..20: mol_type = other DNA
cacaacagatcccccaagtg

SEQ ID NO: 2584 - DNA, 20 bp, Synthetic construct
  source 1..20: mol_type = other DNA
aattcccacaatccagaggc

SEQ ID NO: 2585 - DNA, 20 bp, Synthetic construct
  source 1..20: mol_type = other DNA
ctttctctcctgtttcagca

SEQ ID NO: 2586 - DNA, 20 bp, Synthetic construct
  source 1..20: mol_type = other DNA
aggcctttagaaatgggaca

SEQ ID NO: 2587 - DNA, 20 bp, Synthetic construct
  source 1..20: mol_type = other DNA
ggaccgcaagaggcccttgg

SEQ ID NO: 2588 - DNA, 20 bp, Synthetic construct
  source 1..20: mol_type = other DNA
aaatagggcactacctagaa

SEQ ID NO: 2589 - DNA, 20 bp, Synthetic construct
  source 1..20: mol_type = other DNA
ctgctcagtcaaagcagagt

SEQ ID NO: 2590 - DNA, 20 bp, Synthetic construct
  source 1..20: mol_type = other DNA
tcttgtgaccttgtgatttt

SEQ ID NO: 2591 - DNA, 20 bp, Synthetic construct
  source 1..20: mol_type = other DNA
tcactccctgtcaagctggg

SEQ ID NO: 2592 - DNA, 20 bp, Synthetic construct
  source 1..20: mol_type = other DNA
ttaatgtacagttactctgt

SEQ ID NO: 2593 - DNA, 20 bp, Synthetic construct
  source 1..20: mol_type = other DNA
cgatggagcctcagggatga

SEQ ID NO: 2594 - DNA, 20 bp, Synthetic construct
  source 1..20: mol_type = other DNA
agggaagaatcctctgaact

SEQ ID NO: 2595 - DNA, 20 bp, Synthetic construct
  source 1..20: mol_type = other DNA
agcagggaacataaaacttt

SEQ ID NO: 2596 - DNA, 20 bp, Synthetic construct
  source 1..20: mol_type = other DNA
tgatcctcagtcccagtctg

SEQ ID NO: 2597 - DNA, 20 bp, Synthetic construct
  source 1..20: mol_type = other DNA
aagccccacctagaagtacc

SEQ ID NO: 2598 - DNA, 20 bp, Synthetic construct
  source 1..20: mol_type = other DNA
cctcctcacttctgcctcac

SEQ ID NO: 2599 - DNA, 20 bp, Synthetic construct
  source 1..20: mol_type = other DNA
tcggcccctccctgagactt

SEQ ID NO: 2600 - DNA, 20 bp, Synthetic construct
  source 1..20: mol_type = other DNA
tcctgcactgctttccccag

SEQ ID NO: 2601 - DNA, 20 bp, Synthetic construct
  source 1..20: mol_type = other DNA
tgctctttccctcactttct

SEQ ID NO: 2602 - DNA, 20 bp, Synthetic construct
  source 1..20: mol_type = other DNA
attatgaccaccgcttcaca

SEQ ID NO: 2603 - DNA, 20 bp, Synthetic construct
  source 1..20: mol_type = other DNA
acacacgcacatgtcctcct

SEQ ID NO: 2604 - DNA, 20 bp, Synthetic construct
  source 1..20: mol_type = other DNA
ccttagacagaggacttgtc

SEQ ID NO: 2605 - DNA, 20 bp, Synthetic construct
  source 1..20: mol_type = other DNA
ccacctccctgacctgtcta

SEQ ID NO: 2606 - DNA, 20 bp, Synthetic construct
  source 1..20: mol_type = other DNA
agttgcaatctctgtgttga

SEQ ID NO: 2607 - DNA, 20 bp, Synthetic construct
  source 1..20: mol_type = other DNA
tcctgtctctacctgccaat

SEQ ID NO: 2608 - DNA, 20 bp, Synthetic construct
  source 1..20: mol_type = other DNA
ccaggagttcgaatgctctc

SEQ ID NO: 2609 - DNA, 20 bp, Synthetic construct
  source 1..20: mol_type = other DNA
aacctcctgaccagggtgag

SEQ ID NO: 2610 - DNA, 20 bp, Synthetic construct
  source 1..20: mol_type = other DNA
tctggtgaaagtcagtcacc

SEQ ID NO: 2611 - DNA, 20 bp, Synthetic construct
  source 1..20: mol_type = other DNA
tagcagtaataataatgggt

SEQ ID NO: 2612 - DNA, 20 bp, Synthetic construct
  source 1..20: mol_type = other DNA
tgaaaagcacagggcttaga

SEQ ID NO: 2613 - DNA, 20 bp, Synthetic construct
  source 1..20: mol_type = other DNA
ctctctcatctgtcaaagaa

SEQ ID NO: 2614 - DNA, 20 bp, Synthetic construct
  source 1..20: mol_type = other DNA
atatggtagaggctcagtaa

SEQ ID NO: 2615 - DNA, 20 bp, Synthetic construct
  source 1..20: mol_type = other DNA
ggtgttctctacgggcacta

SEQ ID NO: 2616 - DNA, 20 bp, Synthetic construct
  source 1..20: mol_type = other DNA
tcctggctcccacactacat

SEQ ID NO: 2617 - DNA, 20 bp, Synthetic construct
  source 1..20: mol_type = other DNA
gtgcttttctgcctccaggc

SEQ ID NO: 2618 - DNA, 20 bp, Synthetic construct
  source 1..20: mol_type = other DNA
ccctgctcagacaccagtgg

SEQ ID NO: 2619 - DNA, 20 bp, Synthetic construct
  source 1..20: mol_type = other DNA
gagcggaggcctgggtgttt

SEQ ID NO: 2620 - DNA, 20 bp, Synthetic construct
  source 1..20: mol_type = other DNA
tagcacaacacctggtcagc

SEQ ID NO: 2621 - DNA, 20 bp, Synthetic construct
  source 1..20: mol_type = other DNA
ggaaatcagggaggtgagca

SEQ ID NO: 2622 - DNA, 20 bp, Synthetic construct
  source 1..20: mol_type = other DNA
gcccttctcccctggcatct

SEQ ID NO: 2623 - DNA, 20 bp, Synthetic construct
  source 1..20: mol_type = other DNA
ctctaccgtgaggcagcagg

SEQ ID NO: 2624 - DNA, 20 bp, Synthetic construct
  source 1..20: mol_type = other DNA
ctagtgactgcctgctatgt

SEQ ID NO: 2625 - DNA, 20 bp, Synthetic construct
  source 1..20: mol_type = other DNA
gggagtatgcctcttagttt

SEQ ID NO: 2626 - DNA, 20 bp, Synthetic construct
  source 1..20: mol_type = other DNA
agaaagttccaaggaggcag

SEQ ID NO: 2627 - DNA, 20 bp, Synthetic construct
  source 1..20: mol_type = other DNA
aactccatctcctagctttt

SEQ ID NO: 2628 - DNA, 20 bp, Synthetic construct
  source 1..20: mol_type = other DNA
ccgagagagaaaaatataac

SEQ ID NO: 2629 - DNA, 20 bp, Synthetic construct
  source 1..20: mol_type = other DNA
atttcagggccaatgcaagt

SEQ ID NO: 2630 - DNA, 20 bp, Synthetic construct
  source 1..20: mol_type = other DNA
ttctagtccagaagaagagg

SEQ ID NO: 2631 - DNA, 20 bp, Synthetic construct
  source 1..20: mol_type = other DNA
gatgctgaattaagtcctga

SEQ ID NO: 2632 - DNA, 20 bp, Synthetic construct
  source 1..20: mol_type = other DNA
tacctctactagtcagcctg

SEQ ID NO: 2633 - DNA, 20 bp, Synthetic construct
  source 1..20: mol_type = other DNA
ctgtgactatctaggatttg

SEQ ID NO: 2634 - DNA, 20 bp, Synthetic construct
  source 1..20: mol_type = other DNA
ttatctgtgctttagtgacc

SEQ ID NO: 2635 - DNA, 20 bp, Synthetic construct
  source 1..20: mol_type = other DNA
catattagtgctcaatacac

SEQ ID NO: 2636 - DNA, 20 bp, Synthetic construct
  source 1..20: mol_type = other DNA
acttctctaggtgggagaga

SEQ ID NO: 2637 - DNA, 20 bp, Synthetic construct
  source 1..20: mol_type = other DNA
gtaagactccgtcgaaagca

SEQ ID NO: 2638 - DNA, 20 bp, Synthetic construct
  source 1..20: mol_type = other DNA
tttctgaaaacccagcacgg

SEQ ID NO: 2639 - DNA, 20 bp, Synthetic construct
  source 1..20: mol_type = other DNA
tgagaacctatgcaaccgag

SEQ ID NO: 2640 - DNA, 20 bp, Synthetic construct
  source 1..20: mol_type = other DNA
tttcagggcatgagccatcc

SEQ ID NO: 2641 - DNA, 20 bp, Synthetic construct
  source 1..20: mol_type = other DNA
tcagtttccttgctctcctc

SEQ ID NO: 2642 - DNA, 20 bp, Synthetic construct
  source 1..20: mol_type = other DNA
gatcccatctagtggctttg

SEQ ID NO: 2643 - DNA, 20 bp, Synthetic construct
  source 1..20: mol_type = other DNA
ttctctttctctccctggca

SEQ ID NO: 2644 - DNA, 20 bp, Synthetic construct
  source 1..20: mol_type = other DNA
cccatccccaactgtgtctg

SEQ ID NO: 2645 - DNA, 20 bp, Synthetic construct
  source 1..20: mol_type = other DNA
aagctgctggagtaagatga

SEQ ID NO: 2646 - DNA, 20 bp, Synthetic construct
  source 1..20: mol_type = other DNA
tacttttcttgatagtaacc

SEQ ID NO: 2647 - DNA, 20 bp, Synthetic construct
  source 1..20: mol_type = other DNA
ttaggagttcacacagaccc

SEQ ID NO: 2648 - DNA, 20 bp, Synthetic construct
  source 1..20: mol_type = other DNA
ctcactggcccgggtctcct

SEQ ID NO: 2649 - DNA, 20 bp, Synthetic construct
  source 1..20: mol_type = other DNA
ctgtgccagattgtccctct

SEQ ID NO: 2650 - DNA, 20 bp, Synthetic construct
  source 1..20: mol_type = other DNA
ccacatggacctgctgtcgg

SEQ ID NO: 2651 - DNA, 20 bp, Synthetic construct
  source 1..20: mol_type = other DNA
ttcctccagccgcgccagcg

SEQ ID NO: 2652 - DNA, 20 bp, Synthetic construct
  source 1..20: mol_type = other DNA
tgcttggactccttaatgac

SEQ ID NO: 2653 - DNA, 20 bp, Synthetic construct
  source 1..20: mol_type = other DNA
gggaaatgtgccagcagagg

SEQ ID NO: 2654 - DNA, 20 bp, Synthetic construct
  source 1..20: mol_type = other DNA
ccctccagactgccccttgg

SEQ ID NO: 2655 - DNA, 20 bp, Synthetic construct
  source 1..20: mol_type = other DNA
ccatctctggcaacagtttc

SEQ ID NO: 2656 - DNA, 20 bp, Synthetic construct
  source 1..20: mol_type = other DNA
aagacaaaacaagcctctgg

SEQ ID NO: 2657 - DNA, 20 bp, Synthetic construct
  source 1..20: mol_type = other DNA
gggatatcccacctcataaa

SEQ ID NO: 2658 - DNA, 20 bp, Synthetic construct
  source 1..20: mol_type = other DNA
ccacccatcttagactgatc

SEQ ID NO: 2659 - DNA, 20 bp, Synthetic construct
  source 1..20: mol_type = other DNA
acacaacagatcccccaagt

SEQ ID NO: 2660 - DNA, 20 bp, Synthetic construct
  source 1..20: mol_type = other DNA
taattcccacaatccagagg

SEQ ID NO: 2661 - DNA, 20 bp, Synthetic construct
  source 1..20: mol_type = other DNA
tcccctttctctcctgtttc

SEQ ID NO: 2662 - DNA, 20 bp, Synthetic construct
  source 1..20: mol_type = other DNA
agaggcctttagaaatggga

SEQ ID NO: 2663 - DNA, 20 bp, Synthetic construct
  source 1..20: mol_type = other DNA
aagaagggaccgcaagaggc

SEQ ID NO: 2664 - DNA, 20 bp, Synthetic construct
  source 1..20: mol_type = other DNA
caattgtaaaatagggcact

SEQ ID NO: 2665 - DNA, 20 bp, Synthetic construct
  source 1..20: mol_type = other DNA
cagtctgctcagtcaaagca

SEQ ID NO: 2666 - DNA, 20 bp, Synthetic construct
  source 1..20: mol_type = other DNA
atcttgtgaccttgtgattt

SEQ ID NO: 2667 - DNA, 20 bp, Synthetic construct
  source 1..20: mol_type = other DNA
ctcactccctgtcaagctgg

SEQ ID NO: 2668 - DNA, 20 bp, Synthetic construct
  source 1..20: mol_type = other DNA
cagtttaatgtacagttact

SEQ ID NO: 2669 - DNA, 20 bp, Synthetic construct
  source 1..20: mol_type = other DNA
gcgatggagcctcagggatg

SEQ ID NO: 2670 - DNA, 20 bp, Synthetic construct
  source 1..20: mol_type = other DNA
gagggaagaatcctctgaac

SEQ ID NO: 2671 - DNA, 20 bp, Synthetic construct
  source 1..20: mol_type = other DNA
cattaagagcagggaacata

SEQ ID NO: 2672 - DNA, 20 bp, Synthetic construct
  source 1..20: mol_type = other DNA
gaaggcccccagggagagct

SEQ ID NO: 2673 - DNA, 20 bp, Synthetic construct
  source 1..20: mol_type = other DNA
caagccccacctagaagtac

SEQ ID NO: 2674 - DNA, 20 bp, Synthetic construct
  source 1..20: mol_type = other DNA
ccctcctcacttctgcctca

SEQ ID NO: 2675 - DNA, 20 bp, Synthetic construct
  source 1..20: mol_type = other DNA
ttcggcccctccctgagact

SEQ ID NO: 2676 - DNA, 20 bp, Synthetic construct
  source 1..20: mol_type = other DNA
ccgctgctcctgcactgctt

SEQ ID NO: 2677 - DNA, 20 bp, Synthetic construct
  source 1..20: mol_type = other DNA
cctgctctttccctcacttt

SEQ ID NO: 2678 - DNA, 20 bp, Synthetic construct
  source 1..20: mol_type = other DNA
tattatgaccaccgcttcac

SEQ ID NO: 2679 - DNA, 20 bp, Synthetic construct
  source 1..20: mol_type = other DNA
cacacacgcacatgtcctcc

SEQ ID NO: 2680 - DNA, 20 bp, Synthetic construct
  source 1..20: mol_type = other DNA
gggccttagacagaggactt

SEQ ID NO: 2681 - DNA, 20 bp, Synthetic construct
  source 1..20: mol_type = other DNA
cctccacctccctgacctgt

SEQ ID NO: 2682 - DNA, 20 bp, Synthetic construct
  source 1..20: mol_type = other DNA
cagttgcaatctctgtgttg

SEQ ID NO: 2683 - DNA, 20 bp, Synthetic construct
  source 1..20: mol_type = other DNA
ttcctgtctctacctgccaa

SEQ ID NO: 2684 - DNA, 20 bp, Synthetic construct
  source 1..20: mol_type = other DNA
cttctgcctgcccctcggcc

SEQ ID NO: 2685 - DNA, 20 bp, Synthetic construct
  source 1..20: mol_type = other DNA
gaacctcctgaccagggtga

SEQ ID NO: 2686 - DNA, 20 bp, Synthetic construct
  source 1..20: mol_type = other DNA
ctctggtgaaagtcagtcac

SEQ ID NO: 2687 - DNA, 20 bp, Synthetic construct
  source 1..20: mol_type = other DNA
gtagcagtaataataatggg

SEQ ID NO: 2688 - DNA, 20 bp, Synthetic construct
  source 1..20: mol_type = other DNA
catgaaaagcacagggctta

SEQ ID NO: 2689 - DNA, 20 bp, Synthetic construct
  source 1..20: mol_type = other DNA
gctctctcatctgtcaaaga

SEQ ID NO: 2690 - DNA, 20 bp, Synthetic construct
  source 1..20: mol_type = other DNA
agacacctctctgtgtcctg

SEQ ID NO: 2691 - DNA, 20 bp, Synthetic construct
  source 1..20: mol_type = other DNA
gtggtgttctctacgggcac

SEQ ID NO: 2692 - DNA, 20 bp, Synthetic construct
  source 1..20: mol_type = other DNA
gccccctctacagtgtcttt

SEQ ID NO: 2693 - DNA, 20 bp, Synthetic construct
  source 1..20: mol_type = other DNA
tctgtgcttttctgcctcca

SEQ ID NO: 2694 - DNA, 20 bp, Synthetic construct
  source 1..20: mol_type = other DNA
ctcaccctgctcagacacca

SEQ ID NO: 2695 - DNA, 20 bp, Synthetic construct
  source 1..20: mol_type = other DNA
cgagcggaggcctgggtgtt

SEQ ID NO: 2696 - DNA, 20 bp, Synthetic construct
  source 1..20: mol_type = other DNA
ctagcacaacacctggtcag

SEQ ID NO: 2697 - DNA, 20 bp, Synthetic construct
  source 1..20: mol_type = other DNA
aggtctgcaaactaggtggg

SEQ ID NO: 2698 - DNA, 20 bp, Synthetic construct
  source 1..20: mol_type = other DNA
cccgccctcgacccaggtcc

SEQ ID NO: 2699 - DNA, 20 bp, Synthetic construct
  source 1..20: mol_type = other DNA
gagctctaccgtgaggcagc

SEQ ID NO: 2700 - DNA, 20 bp, Synthetic construct
  source 1..20: mol_type = other DNA
atctagtgactgcctgctat

SEQ ID NO: 2701 - DNA, 20 bp, Synthetic construct
  source 1..20: mol_type = other DNA
agtccaatcttggctgggaa

SEQ ID NO: 2702 - DNA, 20 bp, Synthetic construct
  source 1..20: mol_type = other DNA
gaagaaagttccaaggaggc

SEQ ID NO: 2703 - DNA, 20 bp, Synthetic construct
  source 1..20: mol_type = other DNA
taactccatctcctagcttt

SEQ ID NO: 2704 - DNA, 20 bp, Synthetic construct
  source 1..20: mol_type = other DNA
cccgagagagaaaaatataa

SEQ ID NO: 2705 - DNA, 20 bp, Synthetic construct
  source 1..20: mol_type = other DNA
tcatttcagggccaatgcaa

SEQ ID NO: 2706 - DNA, 20 bp, Synthetic construct
  source 1..20: mol_type = other DNA
tattctagtccagaagaaga

SEQ ID NO: 2707 - DNA, 20 bp, Synthetic construct
  source 1..20: mol_type = other DNA
agcctttctgatgctgaatt

SEQ ID NO: 2708 - DNA, 20 bp, Synthetic construct
  source 1..20: mol_type = other DNA
ttacctctactagtcagcct

SEQ ID NO: 2709 - DNA, 20 bp, Synthetic construct
  source 1..20: mol_type = other DNA
cctgtgactatctaggattt

SEQ ID NO: 2710 - DNA, 20 bp, Synthetic construct
  source 1..20: mol_type = other DNA
tttatctgtgctttagtgac

SEQ ID NO: 2711 - DNA, 20 bp, Synthetic construct
  source 1..20: mol_type = other DNA
catgtggcacatattagtgc

SEQ ID NO: 2712 - DNA, 20 bp, Synthetic construct
  source 1..20: mol_type = other DNA
tacttctctaggtgggagag

SEQ ID NO: 2713 - DNA, 20 bp, Synthetic construct
  source 1..20: mol_type = other DNA
agtaagactccgtcgaaagc

SEQ ID NO: 2714 - DNA, 20 bp, Synthetic construct
  source 1..20: mol_type = other DNA
ctttctgaaaacccagcacg

SEQ ID NO: 2715 - DNA, 20 bp, Synthetic construct
  source 1..20: mol_type = other DNA
atgagaacctatgcaaccga

SEQ ID NO: 2716 - DNA, 20 bp, Synthetic construct
  source 1..20: mol_type = other DNA
ctcatggactttcagggcat

SEQ ID NO: 2717 - DNA, 20 bp, Synthetic construct
  source 1..20: mol_type = other DNA
ttacattcagtttccttgct

SEQ ID NO: 2718 - DNA, 20 bp, Synthetic construct
  source 1..20: mol_type = other DNA
ggatcccatctagtggcttt

SEQ ID NO: 2719 - DNA, 20 bp, Synthetic construct
  source 1..20: mol_type = other DNA
taactttaattctctttctc

SEQ ID NO: 2720 - DNA, 20 bp, Synthetic construct
  source 1..20: mol_type = other DNA
ccccatccccaactgtgtct

SEQ ID NO: 2721 - DNA, 20 bp, Synthetic construct
  source 1..20: mol_type = other DNA
taagctgctggagtaagatg

SEQ ID NO: 2722 - DNA, 20 bp, Synthetic construct
  source 1..20: mol_type = other DNA
ttacttttcttgatagtaac

SEQ ID NO: 2723 - DNA, 20 bp, Synthetic construct
  source 1..20: mol_type = other DNA
gcacagtgcaacagttagga

SEQ ID NO: 2724 - DNA, 20 bp, Synthetic construct
  source 1..20: mol_type = other DNA
ctgcccgctcactggcccgg

SEQ ID NO: 2725 - DNA, 20 bp, Synthetic construct
  source 1..20: mol_type = other DNA
tgcctcacagtggccaggtc

SEQ ID NO: 2726 - DNA, 20 bp, Synthetic construct
  source 1..20: mol_type = other DNA
ctttcagggctgcggtgagg

SEQ ID NO: 2727 - DNA, 20 bp, Synthetic construct
  source 1..20: mol_type = other DNA
tcttcctccagccgcgccag

SEQ ID NO: 2728 - DNA, 20 bp, Synthetic construct
  source 1..20: mol_type = other DNA
ctgcttggactccttaatga

SEQ ID NO: 2729 - DNA, 20 bp, Synthetic construct
  source 1..20: mol_type = other DNA
aagctgacctagggacagag

SEQ ID NO: 2730 - DNA, 20 bp, Synthetic construct
  source 1..20: mol_type = other DNA
cccctccagactgccccttg

SEQ ID NO: 2731 - DNA, 20 bp, Synthetic construct
  source 1..20: mol_type = other DNA
tccatctctggcaacagttt

SEQ ID NO: 2732 - DNA, 20 bp, Synthetic construct
  source 1..20: mol_type = other DNA
aaagacaaaacaagcctctg

SEQ ID NO: 2733 - DNA, 20 bp, Synthetic construct
  source 1..20: mol_type = other DNA
agggatatcccacctcataa

SEQ ID NO: 2734 - DNA, 20 bp, Synthetic construct
  source 1..20: mol_type = other DNA
tgactgccccaggtggcagg

SEQ ID NO: 2735 - DNA, 20 bp, Synthetic construct
  source 1..20: mol_type = other DNA
tacacaacagatcccccaag

SEQ ID NO: 2736 - DNA, 20 bp, Synthetic construct
  source 1..20: mol_type = other DNA
ttaattcccacaatccagag

SEQ ID NO: 2737 - DNA, 20 bp, Synthetic construct
  source 1..20: mol_type = other DNA
atcccctttctctcctgttt

SEQ ID NO: 2738 - DNA, 20 bp, Synthetic construct
  source 1..20: mol_type = other DNA
aagaggcctttagaaatggg

SEQ ID NO: 2739 - DNA, 20 bp, Synthetic construct
  source 1..20: mol_type = other DNA
taagaagggaccgcaagagg

SEQ ID NO: 2740 - DNA, 20 bp, Synthetic construct
  source 1..20: mol_type = other DNA
acaattgtaaaatagggcac

SEQ ID NO: 2741 - DNA, 20 bp, Synthetic construct
  source 1..20: mol_type = other DNA
accagtctgctcagtcaaag

SEQ ID NO: 2742 - DNA, 20 bp, Synthetic construct
  source 1..20: mol_type = other DNA
tatcttgtgaccttgtgatt

SEQ ID NO: 2743 - DNA, 20 bp, Synthetic construct
  source 1..20: mol_type = other DNA
gctcactccctgtcaagctg

SEQ ID NO: 2744 - DNA, 20 bp, Synthetic construct
  source 1..20: mol_type = other DNA
aagctctgccagtttaatgt

SEQ ID NO: 2745 - DNA, 20 bp, Synthetic construct
  source 1..20: mol_type = other DNA
agcgatggagcctcagggat

SEQ ID NO: 2746 - DNA, 20 bp, Synthetic construct
  source 1..20: mol_type = other DNA
tgagggaagaatcctctgaa

SEQ ID NO: 2747 - DNA, 20 bp, Synthetic construct
  source 1..20: mol_type = other DNA
acattaagagcagggaacat

SEQ ID NO: 2748 - DNA, 20 bp, Synthetic construct
  source 1..20: mol_type = other DNA
gtgtcacgaaggcccccagg

SEQ ID NO: 2749 - DNA, 20 bp, Synthetic construct
  source 1..20: mol_type = other DNA
ctgcaagccccacctagaag

SEQ ID NO: 2750 - DNA, 20 bp, Synthetic construct
  source 1..20: mol_type = other DNA
tcacaaggccccccttcccc

SEQ ID NO: 2751 - DNA, 20 bp, Synthetic construct
  source 1..20: mol_type = other DNA
gttcggcccctccctgagac

SEQ ID NO: 2752 - DNA, 20 bp, Synthetic construct
  source 1..20: mol_type = other DNA
cccgctgctcctgcactgct

SEQ ID NO: 2753 - DNA, 20 bp, Synthetic construct
  source 1..20: mol_type = other DNA
tgcctgctctttccctcact

SEQ ID NO: 2754 - DNA, 20 bp, Synthetic construct
  source 1..20: mol_type = other DNA
attttattatgaccaccgct

SEQ ID NO: 2755 - DNA, 20 bp, Synthetic construct
  source 1..20: mol_type = other DNA
tcactgttgcacacacacac

SEQ ID NO: 2756 - DNA, 20 bp, Synthetic construct
  source 1..20: mol_type = other DNA
gcaggaggattaagggttgg

SEQ ID NO: 2757 - DNA, 20 bp, Synthetic construct
  source 1..20: mol_type = other DNA
tgggtggccatcaatccttt

SEQ ID NO: 2758 - DNA, 20 bp, Synthetic construct
  source 1..20: mol_type = other DNA
tcagttgcaatctctgtgtt

SEQ ID NO: 2759 - DNA, 20 bp, Synthetic construct
  source 1..20: mol_type = other DNA
atttcctgtctctacctgcc

SEQ ID NO: 2760 - DNA, 20 bp, Synthetic construct
  source 1..20: mol_type = other DNA
gtcctcttctgcctgcccct

SEQ ID NO: 2761 - DNA, 20 bp, Synthetic construct
  source 1..20: mol_type = other DNA
cagggctaccttggagcggt

SEQ ID NO: 2762 - DNA, 20 bp, Synthetic construct
  source 1..20: mol_type = other DNA
tctcacttctctggtgaaag

SEQ ID NO: 2763 - DNA, 20 bp, Synthetic construct
  source 1..20: mol_type = other DNA
agtagcagtaataataatgg

SEQ ID NO: 2764 - DNA, 20 bp, Synthetic construct
  source 1..20: mol_type = other DNA
aatccatgaaaagcacaggg

SEQ ID NO: 2765 - DNA, 20 bp, Synthetic construct
  source 1..20: mol_type = other DNA
ggctctctcatctgtcaaag

SEQ ID NO: 2766 - DNA, 20 bp, Synthetic construct
  source 1..20: mol_type = other DNA
cagacacctctctgtgtcct

SEQ ID NO: 2767 - DNA, 20 bp, Synthetic construct
  source 1..20: mol_type = other DNA
tgtggtgttctctacgggca

SEQ ID NO: 2768 - DNA, 20 bp, Synthetic construct
  source 1..20: mol_type = other DNA
aaatgccccctctacagtgt

SEQ ID NO: 2769 - DNA, 20 bp, Synthetic construct
  source 1..20: mol_type = other DNA
ctctgtgcttttctgcctcc

SEQ ID NO: 2770 - DNA, 20 bp, Synthetic construct
  source 1..20: mol_type = other DNA
tcgggccctcaccctgctca

SEQ ID NO: 2771 - DNA, 20 bp, Synthetic construct
  source 1..20: mol_type = other DNA
ggcgagcggaggcctgggtg

SEQ ID NO: 2772 - DNA, 20 bp, Synthetic construct
  source 1..20: mol_type = other DNA
acctcagcacctagcacaac

SEQ ID NO: 2773 - DNA, 20 bp, Synthetic construct
  source 1..20: mol_type = other DNA
tcaggtctgcaaactaggtg

SEQ ID NO: 2774 - DNA, 20 bp, Synthetic construct
  source 1..20: mol_type = other DNA
ccccgccctcgacccaggtc

SEQ ID NO: 2775 - DNA, 20 bp, Synthetic construct
  source 1..20: mol_type = other DNA
atgagctctaccgtgaggca

SEQ ID NO: 2776 - DNA, 20 bp, Synthetic construct
  source 1..20: mol_type = other DNA
acatctagtgactgcctgct

SEQ ID NO: 2777 - DNA, 20 bp, Synthetic construct
  source 1..20: mol_type = other DNA
aggagtccaatcttggctgg

SEQ ID NO: 2778 - DNA, 20 bp, Synthetic construct
  source 1..20: mol_type = other DNA
tgaagaaagttccaaggagg

SEQ ID NO: 2779 - DNA, 20 bp, Synthetic construct
  source 1..20: mol_type = other DNA
aaagtctaactccatctcct

SEQ ID NO: 2780 - DNA, 20 bp, Synthetic construct
  source 1..20: mol_type = other DNA
cccgccccgcccgagagaga

SEQ ID NO: 2781 - DNA, 20 bp, Synthetic construct
  source 1..20: mol_type = other DNA
aatcatttcagggccaatgc

SEQ ID NO: 2782 - DNA, 20 bp, Synthetic construct
  source 1..20: mol_type = other DNA
atattctagtccagaagaag

SEQ ID NO: 2783 - DNA, 20 bp, Synthetic construct
  source 1..20: mol_type = other DNA
tagcctttctgatgctgaat

SEQ ID NO: 2784 - DNA, 20 bp, Synthetic construct
  source 1..20: mol_type = other DNA
attacctctactagtcagcc

SEQ ID NO: 2785 - DNA, 20 bp, Synthetic construct
  source 1..20: mol_type = other DNA
acctgtgactatctaggatt

SEQ ID NO: 2786 - DNA, 20 bp, Synthetic construct
  source 1..20: mol_type = other DNA
atttatctgtgctttagtga

SEQ ID NO: 2787 - DNA, 20 bp, Synthetic construct
  source 1..20: mol_type = other DNA
acatgtggcacatattagtg

SEQ ID NO: 2788 - DNA, 20 bp, Synthetic construct
  source 1..20: mol_type = other DNA
ctacttctctaggtgggaga

SEQ ID NO: 2789 - DNA, 20 bp, Synthetic construct
  source 1..20: mol_type = other DNA
gagtaagactccgtcgaaag

SEQ ID NO: 2790 - DNA, 20 bp, Synthetic construct
  source 1..20: mol_type = other DNA
tcagcccctctgcaagccct

SEQ ID NO: 2791 - DNA, 20 bp, Synthetic construct
  source 1..20: mol_type = other DNA
tatgagaacctatgcaaccg

SEQ ID NO: 2792 - DNA, 20 bp, Synthetic construct
  source 1..20: mol_type = other DNA
tctcatggactttcagggca

SEQ ID NO: 2793 - DNA, 20 bp, Synthetic construct
  source 1..20: mol_type = other DNA
attacattcagtttccttgc

SEQ ID NO: 2794 - DNA, 20 bp, Synthetic construct
  source 1..20: mol_type = other DNA
aggatcccatctagtggctt

SEQ ID NO: 2795 - DNA, 20 bp, Synthetic construct
  source 1..20: mol_type = other DNA
actaactttaattctctttc

SEQ ID NO: 2796 - DNA, 20 bp, Synthetic construct
  source 1..20: mol_type = other DNA
aaagccctccccatccccaa

SEQ ID NO: 2797 - DNA, 20 bp, Synthetic construct
  source 1..20: mol_type = other DNA
ggtaagctgctggagtaaga

SEQ ID NO: 2798 - DNA, 20 bp, Synthetic construct
  source 1..20: mol_type = other DNA
cttacttttcttgatagtaa

SEQ ID NO: 2799 - DNA, 20 bp, Synthetic construct
  source 1..20: mol_type = other DNA
ctccttaatgacctgcaggg

SEQ ID NO: 2800 - DNA, 20 bp, Synthetic construct
  source 1..20: mol_type = other DNA
ccctcgaatctgcaggttgg

SEQ ID NO: 2801 - DNA, 20 bp, Synthetic construct
  source 1..20: mol_type = other DNA
ttttgccccctcgaatctgc

SEQ ID NO: 2802 - DNA, 20 bp, Synthetic construct
  source 1..20: mol_type = other DNA
cttttgccccctcgaatctg

SEQ ID NO: 2803 - DNA, 20 bp, Synthetic construct
  source 1..20: mol_type = other DNA
gcttttgccccctcgaatct

SEQ ID NO: 2804 - DNA, 20 bp, Synthetic construct
  source 1..20: mol_type = other DNA
gtgcttttgccccctcgaat

SEQ ID NO: 2805 - DNA, 20 bp, Synthetic construct
  source 1..20: mol_type = other DNA
tggtgcttttgccccctcga

SEQ ID NO: 2806 - DNA, 20 bp, Synthetic construct
  source 1..20: mol_type = other DNA
tttggtgcttttgccccctc

SEQ ID NO: 2807 - DNA, 20 bp, Synthetic construct
  source 1..20: mol_type = other DNA
ttaatatttaacattaagag

SEQ ID NO: 2808 - DNA, 20 bp, Synthetic construct
  source 1..20: mol_type = other DNA
acgtcacattcactaatatt

SEQ ID NO: 2809 - DNA, 20 bp, Synthetic construct
  source 1..20: mol_type = other DNA
cacgtcacattcactaatat

SEQ ID NO: 2810-2812 - skipped (3 entries)

SEQ ID NO: 2813 - DNA, 20 bp, Synthetic construct
  source 1..20: mol_type = other DNA
gtggtcctaaatattctagt

SEQ ID NO: 2814-2815 - skipped (2 entries)

SEQ ID NO: 2816 - DNA, 18 bp, Synthetic construct
  source 1..18: mol_type = other DNA
gcagtattacctctacta

SEQ ID NO: 2817 - DNA, 18 bp, Synthetic construct
  source 1..18: mol_type = other DNA
ggcagtattacctctact

SEQ ID NO: 2818 - DNA, 18 bp, Synthetic construct
  source 1..18: mol_type = other DNA
tggcagtattacctctac

SEQ ID NO: 2819 - DNA, 18 bp, Synthetic construct
  source 1..18: mol_type = other DNA
tcagcctggttagccttt

SEQ ID NO: 2820 - DNA, 18 bp, Synthetic construct
  source 1..18: mol_type = other DNA
gtcagcctggttagcctt

SEQ ID NO: 2821 - DNA, 18 bp, Synthetic construct
  source 1..18: mol_type = other DNA
agtcagcctggttagcct

SEQ ID NO: 2822 - DNA, 18 bp, Synthetic construct
  source 1..18: mol_type = other DNA
gtgtattaggatcccatc

SEQ ID NO: 2823 - DNA, 18 bp, Synthetic construct
  source 1..18: mol_type = other DNA
tgtgtattaggatcccat

SEQ ID NO: 2824 - DNA, 18 bp, Synthetic construct
  source 1..18: mol_type = other DNA
gtgtgtattaggatccca

SEQ ID NO: 2825 - DNA, 18 bp, Synthetic construct
  source 1..18: mol_type = other DNA
ttatttttcctcagcgac

SEQ ID NO: 2826 - DNA, 18 bp, Synthetic construct
  source 1..18: mol_type = other DNA
tttatttttcctcagcga

SEQ ID NO: 2827 - DNA, 18 bp, Synthetic construct
  source 1..18: mol_type = other DNA
ctttatttttcctcagcg

SEQ ID NO: 2828 - DNA, 18 bp, Synthetic construct
  source 1..18: mol_type = other DNA
tctttatttttcctcagc

SEQ ID NO: 2829 - DNA, 18 bp, Synthetic construct
  source 1..18: mol_type = other DNA
gtctttatttttcctcag

SEQ ID NO: 2830 - DNA, 18 bp, Synthetic construct
  source 1..18: mol_type = other DNA
tgtctttatttttcctca

SEQ ID NO: 2831 - DNA, 18 bp, Synthetic construct
  source 1..18: mol_type = other DNA
ttgtctttatttttcctc

SEQ ID NO: 2832 - DNA, 18 bp, Synthetic construct
  source 1..18: mol_type = other DNA
tttgtctttatttttcct

SEQ ID NO: 2833 - DNA, 18 bp, Synthetic construct
  source 1..18: mol_type = other DNA
atttgtctttatttttcc

SEQ ID NO: 2834 - DNA, 18 bp, Synthetic construct
  source 1..18: mol_type = other DNA
tgattttccccgtctttg

SEQ ID NO: 2835 - DNA, 18 bp, Synthetic construct
  source 1..18: mol_type = other DNA
gtgattttccccgtcttt

SEQ ID NO: 2836 - DNA, 18 bp, Synthetic construct
  source 1..18: mol_type = other DNA
tgtgattttccccgtctt

SEQ ID NO: 2837 - DNA, 18 bp, Synthetic construct
  source 1..18: mol_type = other DNA
gagatatcttgtgacctt

SEQ ID NO: 2838 - skipped

SEQ ID NO: 2839 - DNA, 18 bp, Synthetic construct
  source 1..18: mol_type = other DNA
ttgagatatcttgtgacc

SEQ ID NO: 2840 - DNA, 18 bp, Synthetic construct
  source 1..18: mol_type = other DNA
cacattcactaatattta

SEQ ID NO: 2841 - DNA, 18 bp, Synthetic construct
  source 1..18: mol_type = other DNA
tcacattcactaatattt

SEQ ID NO: 2842 - DNA, 18 bp, Synthetic construct
  source 1..18: mol_type = other DNA
gtcacattcactaatatt

SEQ ID NO: 2843 - DNA, 18 bp, Synthetic construct
  source 1..18: mol_type = other DNA
catttgtctttatttttc

SEQ ID NO: 2844 - DNA, 18 bp, Synthetic construct
  source 1..18: mol_type = other DNA
gcatttgtctttattttt

SEQ ID NO: 2845 - DNA, 18 bp, Synthetic construct
  source 1..18: mol_type = other DNA
agcatttgtctttatttt

SEQ ID NO: 2846 - DNA, 18 bp, Synthetic construct
  source 1..18: mol_type = other DNA
cagcatttgtctttattt

SEQ ID NO: 2847-2849 - skipped (3 entries)

SEQ ID NO: 2850 - DNA, 18 bp, Synthetic construct
  source 1..18: mol_type = other DNA
ttgtgattttccccgtct

SEQ ID NO: 2851 - DNA, 18 bp, Synthetic construct
  source 1..18: mol_type = other DNA
tttgagatatcttgtgac

SEQ ID NO: 2852 - DNA, 18 bp, Synthetic construct
  source 1..18: mol_type = other DNA
attcactaatatttaaca

SEQ ID NO: 2853 - DNA, 18 bp, Synthetic construct
  source 1..18: mol_type = other DNA
cattcactaatatttaac

SEQ ID NO: 2854 - DNA, 18 bp, Synthetic construct
  source 1..18: mol_type = other DNA
cgtcacattcactaatat

SEQ ID NO: 2855 - skipped

SEQ ID NO: 2856 - DNA, 18 bp, Synthetic construct
  source 1..18: mol_type = other DNA
agcctggttagcctttct

SEQ ID NO: 2857-2858 - skipped (2 entries)

SEQ ID NO: 2859 - DNA, 18 bp, Synthetic construct
  source 1..18: mol_type = other DNA
agtattacctctactagt

SEQ ID NO: 2860 - skipped

SEQ ID NO: 2861 - DNA, 18 bp, Synthetic construct
  source 1..18: mol_type = other DNA
ttggcagtattacctcta

SEQ ID NO: 2862 - DNA, 18 bp, Synthetic construct
  source 1..18: mol_type = other DNA
tattaggatcccatctag

SEQ ID NO: 2863 - DNA, 18 bp, Synthetic construct
  source 1..18: mol_type = other DNA
gtattaggatcccatcta

SEQ ID NO: 2864-2865 - skipped (2 entries)

SEQ ID NO: 2866 - DNA, 18 bp, Synthetic construct
  source 1..18: mol_type = other DNA
gcttttgagatatcttgt

SEQ ID NO: 2867-2872 - skipped (6 entries)

SEQ ID NO: 2873 - DNA, 18 bp, Synthetic construct
  source 1..18: mol_type = other DNA
ccatttatctgtgcttta

SEQ ID NO: 2874 - DNA, 18 bp, Synthetic construct
  source 1..18: mol_type = other DNA
tgccatttatctgtgctt

SEQ ID NO: 2875 - DNA, 18 bp, Synthetic construct
  source 1..18: mol_type = other DNA
ctgccatttatctgtgct

SEQ ID NO: 2876 - DNA, 18 bp, Synthetic construct
  source 1..18: mol_type = other DNA
tctgccatttatctgtgc

SEQ ID NO: 2877-2885 - skipped (9 entries)

SEQ ID NO: 2886 - DNA, 18 bp, Synthetic construct
  source 1..18: mol_type = other DNA
actatctaggatttggca

SEQ ID NO: 2887 - DNA, 18 bp, Synthetic construct
  source 1..18: mol_type = other DNA
tgtgactatctaggattt

SEQ ID NO: 2888 - DNA, 18 bp, Synthetic construct
  source 1..18: mol_type = other DNA
tatctgtgctttagtgac

SEQ ID NO: 2889-2890 - skipped (2 entries)

SEQ ID NO: 2891 - DNA, 18 bp, Synthetic construct
  source 1..18: mol_type = other DNA
gccatttatctgtgcttt

SEQ ID NO: 2892 - DNA, 18 bp, Synthetic construct
  source 1..18: mol_type = other DNA
aaccggatcaccattccc

SEQ ID NO: 2893 - DNA, 20 bp, Synthetic construct
  source 1..20: mol_type = other DNA
ccttgtgattttccccgtct

SEQ ID NO: 2894 - DNA, 22 bp, Synthetic construct
  source 1..22: mol_type = other DNA
tgcttttgccccctcgaatctg

SEQ ID NO: 2895 - DNA, 18 bp, Synthetic construct
  source 1..18: mol_type = other DNA
aaccggatcaccattccc

SEQ ID NO: 2896 - DNA, 21 bp, Synthetic construct
  source 1..21: mol_type = other DNA
gtcttcaccacgatgttcctc

SEQ ID NO: 2897 - DNA, 24 bp, Synthetic construct
  source 1..24: mol_type = other DNA
caccaagtctgtgtcagaaggcca

SEQ ID NO: 2898 - DNA, 19 bp, Synthetic construct
  source 1..19: mol_type = other DNA
gaaggtgaaggtcggagtc

SEQ ID NO: 2899 - DNA, 20 bp, Synthetic construct
  source 1..20: mol_type = other DNA
gaagatggtgatgggatttc

SEQ ID NO: 2900 - DNA, 20 bp, Synthetic construct
  source 1..20: mol_type = other DNA
caagcttcccgttctcagcc

SEQ ID NO: 2901 - DNA, 18 bp, synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE guanosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11: mod_base = OTHER; note = 2'-deoxyadenosine 3'-phosphorothioate
  modified_base 12..13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE 5-methylcytidine
tggcagtattacctctac

SEQ ID NO: 2902 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3..4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..10: mod_base = OTHER; note = 2'-deoxythymidine 3'-phosphorothioate
  modified_base 11..12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphodiester
  modified_base 17: mod_base = OTHER; note = 2'-MOE 5-methylcytidine 3'-phosphodiester
  modified_base 18..19: mod_base = OTHER; note = 2'-MOE adenosine 3'-phosphorothioate
  modified_base 20: mod_base = OTHER; note = 2'-MOE 5-methylcytidine
gcaacagtttccataacaac

SEQ ID NO: 2903 - DNA, 20 bp, synthetic construct
  source 1..20: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE thymidine 3'-phosphodiester
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9..10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14..15: mod_base = OTHER; note = 2'-deoxythymidine 3'-phosphorothioate
  modified_base 16: mod_base = OTHER; note = 2'-MOE thymidine 3'-phosphodiester
  modified_base 17: mod_base = OTHER; note = 2'-MOE guanosine 3'-phosphodiester
  modified_base 18: mod_base = OTHER; note = 2'-MOE 5-methylcytidine 3'-phosphorothioate
  modified_base 19: mod_base = OTHER; note = 2'-MOE thymidine 3'-phosphorothioate
  modified_base 20: mod_base = OTHER; note = 2'-MOE 5-methylcytidine
ccagtgtcttcactttgctc

SEQ ID NO: 2904 - DNA, 20 bp, synthetic construct
  source 1..20: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5..6: mod_base = OTHER; note = 2'-MOE thymidine 3'-phosphodiester
  modified_base 7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11..12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-deoxyadenosine 3'-phosphorothioate
  modified_base 15..16: mod_base = OTHER; note = 2'-deoxythymidine 3'-phosphorothioate
  modified_base 17: mod_base = OTHER; note = 2'-MOE thymidine 3'-phosphodiester
  modified_base 18..19: mod_base = OTHER; note = 2'-MOE adenosine 3'-phosphorothioate
  modified_base 20: mod_base = OTHER; note = 2'-MOE 5-methylcytidine
cacattcactaatatttaac

SEQ ID NO: 2905 - DNA, 20 bp, synthetic construct
  source 1..20: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphodiester
  modified_base 6: mod_base = OTHER; note = 2'-MOE thymidine 3'-phosphodiester
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14: mod_base = OTHER; note = 2'-deoxyadenosine 3'-phosphorothioate
  modified_base 15: mod_base = OTHER; note = 5-methyl-2'-deoxycytidine 3'-phosphorothioate
  modified_base 16: mod_base = OTHER; note = 2'-deoxythymidine 3'-phosphorothioate
  modified_base 17: mod_base = OTHER; note = 2'-MOE adenosine 3'-phosphodiester
  modified_base 18: mod_base = OTHER; note = 2'-MOE guanosine 3'-phosphorothioate
  modified_base 19: mod_base = OTHER; note = 2'-MOE thymidine 3'-phosphorothioate
  modified_base 20: mod_base = OTHER; note = 2'-MOE 5-methylcytidine
cagtattacctctactagtc

SEQ ID NO: 2906 - DNA, 20 bp, synthetic construct
  source 1..20: mol_type = other DNA
  modified_base 1: mod_base = OTHER; note = 2'-MOE thymidine 3'-phosphorothioate
  modified_base 2..3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphodiester
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8..10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13..14: mod_base = OTHER; note = 2'-deoxythymidine 3'-phosphorothioate
  modified_base 15: mod_base = OTHER; note = 5-methyl-2'-deoxycytidine 3'-phosphorothioate
  modified_base 16: mod_base = OTHER; note = 2'-MOE thymidine 3'-phosphodiester
  modified_base 17: mod_base = OTHER; note = 2'-MOE adenosine 3'-phosphodiester
  modified_base 18: mod_base = OTHER; note = 2'-MOE guanosine 3'-phosphorothioate
  modified_base 19: mod_base = OTHER; note = 2'-MOE thymidine 3'-phosphorothioate
  modified_base 20: mod_base = OTHER; note = 2'-MOE 5-methylcytidine
tggtcctaaatattctagtc

The invention claimed is:

1. A modified oligonucleotide according to the following chemical structure:

(SEQ ID NO: 21)

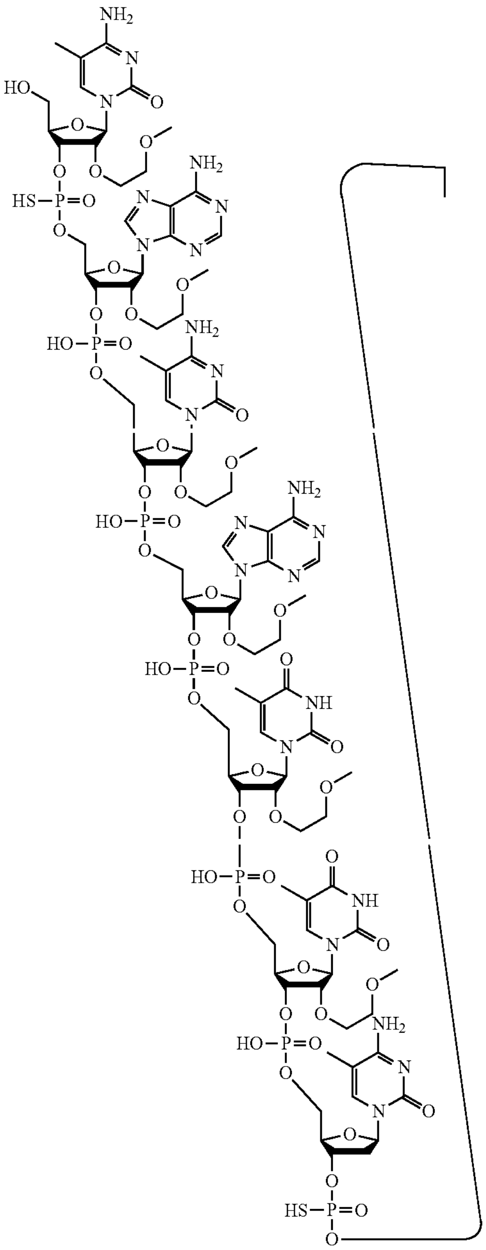

-continued

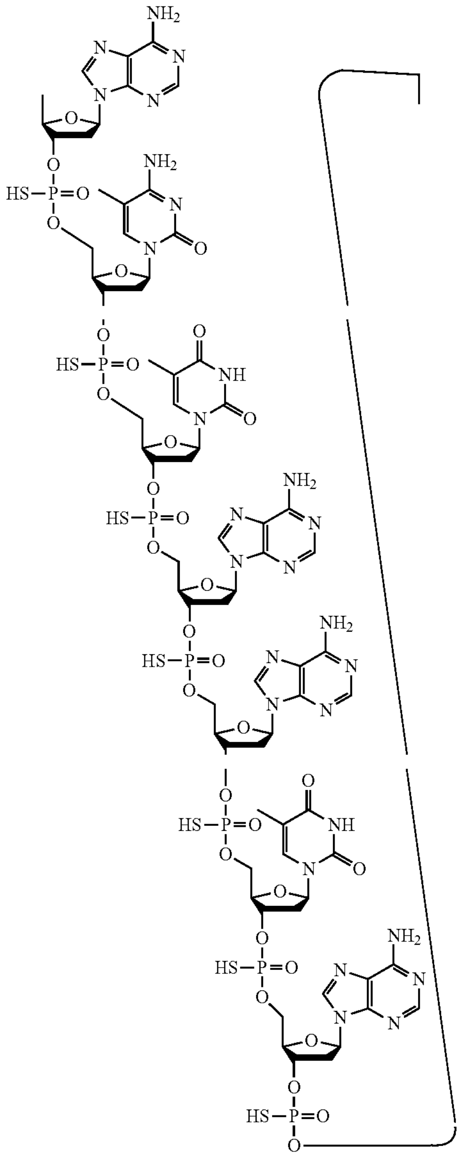

-continued
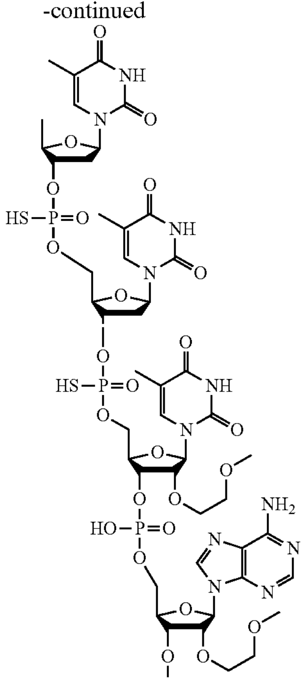
-continued
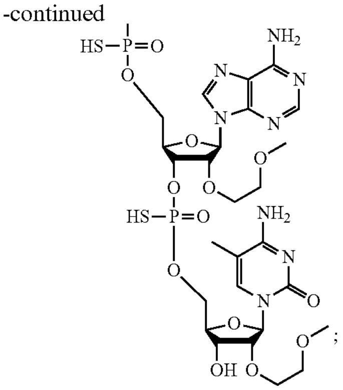
or a salt thereof.
2. A modified oligonucleotide according to the following chemical structure:
(SEQ ID NO: 21)
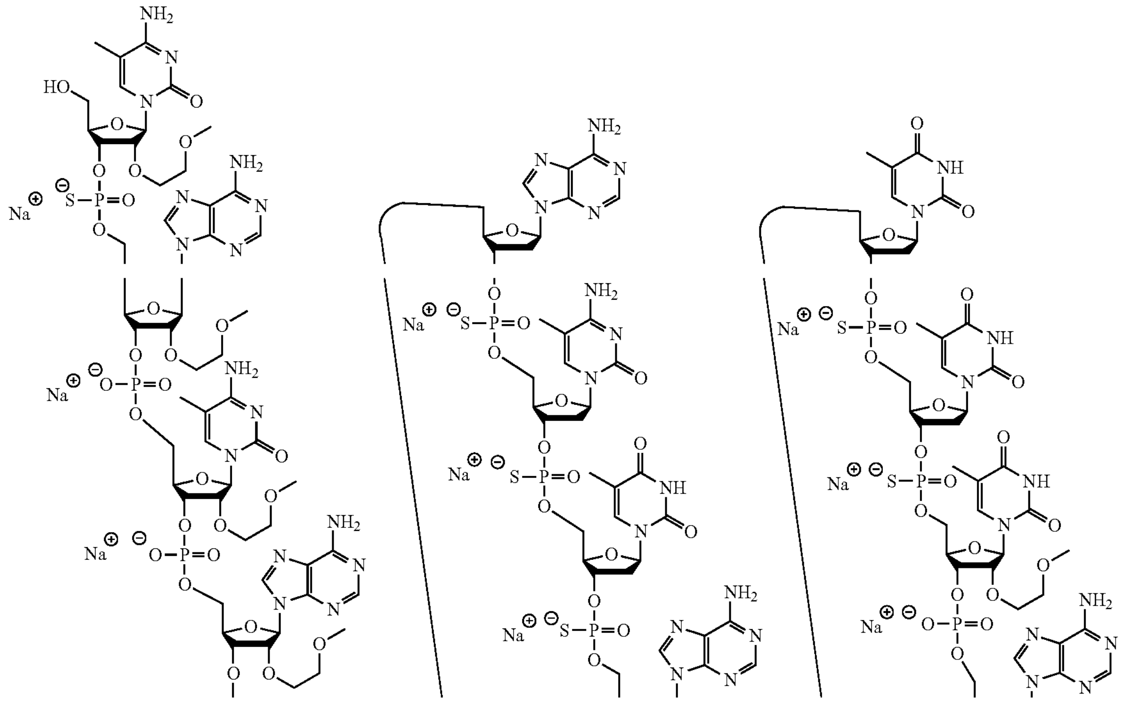

-continued

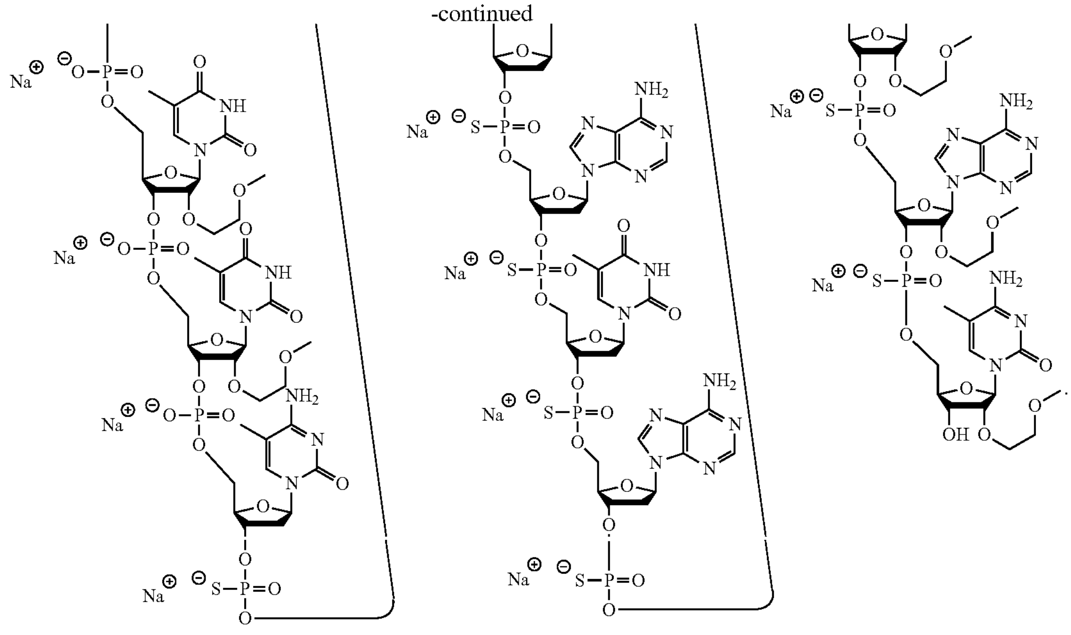

3. The modified oligonucleotide of claim 1, which is the sodium salt or the potassium salt.

4. A pharmaceutical composition comprising the modified oligonucleotide of claim 1 and a pharmaceutically acceptable diluent.

5. The pharmaceutical composition of claim 4, wherein the pharmaceutically acceptable diluent is artificial cerebrospinal fluid or phosphate-buffered saline (PBS).

6. The pharmaceutical composition of claim 5, wherein the pharmaceutical composition consists of the modified oligonucleotide and artificial cerebrospinal fluid.

7. An oligomeric compound comprising a modified oligonucleotide according to the following chemical notation:

${}^{m}C_{es}A_{eo}{}^{m}C_{eo}A_{eo}T_{eo}T_{eo}{}^{m}C_{ds}A_{ds}{}^{m}C_{ds}T_{ds}A_{ds}A_{ds}T_{ds}A_{ds}T_{ds}T_{ds}T_{eo}A_{es}A_{es}{}^{m}C_{e}$ (SEQ ID NO: 21), wherein:

A=an adenine nucleobase, ${}^{m}C$=a 5-methylcytosine nucleobase,

G=a guanine nucleobase,

T=a thymine nucleobase, e=a 2'-MOE sugar moiety, d=a 2'-deoxyribosyl sugar moiety, s=a phosphorothioate internucleoside linkage, and o=a phosphodiester internucleoside linkage.

8. The oligomeric compound of claim 7, comprising the modified oligonucleotide covalently linked to a conjugate group.

9. A pharmaceutical composition comprising the oligomeric compound of claim 7, and a pharmaceutically acceptable diluent.

10. The pharmaceutical composition of claim 9, wherein the pharmaceutically acceptable diluent is artificial cerebrospinal fluid or PBS.

11. The pharmaceutical composition of claim 10, wherein the pharmaceutical composition consists of the oligomeric compound and artificial cerebrospinal fluid.

12. A method comprising administering to an individual the pharmaceutical composition of claim 4.

13. A method of treating Alexander disease, comprising administering to an individual having or at risk of having Alexander disease a therapeutically effective amount of the pharmaceutical composition according to claim 4, thereby treating Alexander disease.

14. The method of claim 13, wherein at least one symptom or hallmark of Alexander disease is ameliorated.

15. The method of claim 14, wherein at least one symptom or hallmark is any of motor delays, cognitive delays, paroxysmal deterioration, seizures, vomiting, swallowing difficulties, ataxic gait, palatal myoclonus, autonomic dysfunction, or the presence of intra-astrocytic inclusions called Rosenthal fibers.

16. The method of claim 13, wherein the pharmaceutical composition is administered to the central nervous system or systemically.

17. The method of claim 13, wherein the pharmaceutical composition is administered to the central nervous system and systemically.

18. The pharmaceutical composition of claim 5, wherein the pharmaceutical composition consists essentially of the modified oligonucleotide and artificial cerebrospinal fluid.

19. The pharmaceutical composition of claim 10, wherein the pharmaceutical composition consists essentially of the oligomeric compound and artificial cerebrospinal fluid.

20. The pharmaceutical composition of claim 5, wherein the pharmaceutical composition consists essentially of the modified oligonucleotide and PBS.

21. The pharmaceutical composition of claim 10, wherein the pharmaceutical composition consists essentially of the oligomeric compound and PBS.

22. A pharmaceutical composition comprising the modified oligonucleotide of claim 2 and a pharmaceutically acceptable diluent.

23. The pharmaceutical composition of claim 22, wherein the pharmaceutically acceptable diluent is artificial cerebrospinal fluid or PBS.

24. The pharmaceutical composition of claim 23, wherein the pharmaceutical composition consists essentially of the modified oligonucleotide and artificial cerebrospinal fluid.

25. The pharmaceutical composition of claim 23, wherein the pharmaceutical composition consists essentially of the modified oligonucleotide and PBS.

26. A pharmaceutical composition comprising the modified oligonucleotide of claim 3 and a pharmaceutically acceptable diluent.

27. The pharmaceutical composition of claim 26, wherein the pharmaceutically acceptable diluent is artificial cerebrospinal fluid or PBS.

28. The pharmaceutical composition of claim 27, wherein the pharmaceutical composition consists essentially of the modified oligonucleotide and artificial cerebrospinal fluid.

29. The pharmaceutical composition of claim 27, wherein the pharmaceutical composition consists essentially of the modified oligonucleotide and PBS.

30. A population of modified oligonucleotides of claim 1, wherein all of the phosphorothioate internucleoside linkages of the modified oligonucleotide are stereorandom.

31. A population of modified oligonucleotides of claim 2, wherein all of the phosphorothioate internucleoside linkages of the modified oligonucleotide are stereorandom.

32. A population of modified oligonucleotides of claim 3, wherein all of the phosphorothioate internucleoside linkages of the modified oligonucleotide are stereorandom.

33. A population of oligomeric compounds of claim 7, wherein all of the phosphorothioate internucleoside linkages of the modified oligonucleotide are stereorandom.

34. A pharmaceutical composition comprising the population of modified oligonucleotides of claim 30 and a pharmaceutically acceptable diluent.

35. The pharmaceutical composition of claim 34, wherein the pharmaceutically acceptable diluent is artificial cerebrospinal fluid or PBS.

36. A pharmaceutical composition comprising the population of modified oligonucleotides of claim 31 and a pharmaceutically acceptable diluent.

37. The pharmaceutical composition of claim 36, wherein the pharmaceutically acceptable diluent is artificial cerebrospinal fluid or PBS.

38. A pharmaceutical composition comprising the population of modified oligonucleotides of claim 32 and a pharmaceutically acceptable diluent.

39. The pharmaceutical composition of claim 38, wherein the pharmaceutically acceptable diluent is artificial cerebrospinal fluid or PBS.

40. A pharmaceutical composition comprising the population of oligomeric compounds of claim 33 and a pharmaceutically acceptable diluent.

41. The pharmaceutical composition of claim 40, wherein the pharmaceutically acceptable diluent is artificial cerebrospinal fluid or PBS.

42. The method of claim 12, wherein the individual has or is at risk of having Alexander disease.

* * * * *